(12) United States Patent
Arnaud Barbe et al.

(10) Patent No.: US 12,263,213 B2
(45) Date of Patent: Apr. 1, 2025

(54) COMPOSITIONS FOR USE IN TREATMENT OF CHLAMYDIA

(71) Applicant: SANOFI, Paris (FR)

(72) Inventors: Nadège Arnaud Barbe, Paris (FR); Leah Cole, Cambridge, MA (US); Andreas Karlsson, Paris (FR); Violette Sanchez, Paris (FR); Timothy Tibbitts, Cambridge, MA (US)

(73) Assignee: SANOFI PASTEUR, Lyons (FR)

( * ) Notice: Subject to any disclaimer, the term of this patent is extended or adjusted under 35 U.S.C. 154(b) by 0 days.

(21) Appl. No.: 18/594,291

(22) Filed: Mar. 4, 2024

(65) Prior Publication Data

US 2024/0299524 A1    Sep. 12, 2024

Related U.S. Application Data

(60) Provisional application No. 63/500,393, filed on May 5, 2023, provisional application No. 63/449,571, filed on Mar. 2, 2023.

(30) Foreign Application Priority Data

Mar. 20, 2023   (EP) ..................................... 23305375
Aug. 11, 2023   (EP) ..................................... 23306372

(51) Int. Cl.
*A61K 39/118*   (2006.01)
*A61P 31/04*    (2006.01)
*C07K 14/295*   (2006.01)
*A61K 39/00*    (2006.01)

(52) U.S. Cl.
CPC ............ *A61K 39/118* (2013.01); *A61P 31/04* (2018.01); *C07K 14/295* (2013.01); *A61K 2039/53* (2013.01); *A61K 2039/70* (2013.01); *C12N 2760/16134* (2013.01)

(58) Field of Classification Search
None
See application file for complete search history.

(56) References Cited

U.S. PATENT DOCUMENTS

| | | |
|---|---|---|
| 4,373,071 A | 2/1983 | Itakura et al. |
| 4,401,796 A | 8/1983 | Itakura et al. |
| 4,415,732 A | 11/1983 | Caruthers et al. |
| 4,458,066 A | 7/1984 | Caruthers et al. |
| 4,500,707 A | 2/1985 | Caruthers et al. |
| 4,668,777 A | 5/1987 | Caruthers et al. |
| 4,973,679 A | 11/1990 | Caruthers et al. |
| 5,047,524 A | 9/1991 | Andrus et al. |
| 5,132,418 A | 7/1992 | Caruthers et al. |
| 5,153,319 A | 10/1992 | Caruthers et al. |
| 5,262,530 A | 11/1993 | Andrus et al. |
| 5,700,642 A | 12/1997 | Monforte et al. |
| 5,744,335 A | 4/1998 | Wolff et al. |
| 5,885,613 A | 3/1999 | Holland et al. |
| 6,001,372 A | 12/1999 | Demars et al. |
| 6,194,388 B1 | 2/2001 | Krieg et al. |
| 6,207,646 B1 | 3/2001 | Krieg et al. |
| 6,214,806 B1 | 4/2001 | Krieg et al. |
| 6,218,371 B1 | 4/2001 | Krieg et al. |
| 6,239,116 B1 | 5/2001 | Krieg et al. |
| 6,299,884 B1 | 10/2001 | Van Nest et al. |
| 6,339,068 B1 | 1/2002 | Krieg et al. |
| 6,344,202 B1 | 2/2002 | Brunham |
| 6,384,206 B1 | 5/2002 | Caldwell et al. |
| 6,406,705 B1 | 6/2002 | Davis et al. |
| 6,429,199 B1 | 8/2002 | Krieg et al. |
| 6,451,325 B1 | 9/2002 | Van Nest et al. |
| 6,464,979 B1 | 10/2002 | Murdin et al. |
| 6,623,739 B1 | 9/2003 | Momin et al. |
| 6,838,085 B2 | 1/2005 | Brunham |
| 7,029,678 B2 | 4/2006 | Momin et al. |
| 7,063,853 B1 | 6/2006 | Brunham |
| 7,220,423 B2 | 5/2007 | Brunham |
| 7,462,357 B2 | 12/2008 | Bhatia et al. |
| 7,510,698 B2 | 3/2009 | Momin et al. |
| 7,575,913 B2 | 8/2009 | Griffais et al. |
| 7,754,228 B2 | 7/2010 | Bensi et al. |
| 8,052,975 B2 | 11/2011 | Bhatia et al. |
| 8,263,089 B2 | 9/2012 | Bhatia et al. |
| 8,481,057 B2 | 7/2013 | Grandi et al. |
| 8,679,510 B2 | 3/2014 | Stephens et al. |
| 8,703,095 B2 | 4/2014 | Klucker et al. |

(Continued)

FOREIGN PATENT DOCUMENTS

WO   WO 1990/014837 A1   12/1990
WO   WO 1994/006827 A1   3/1994

(Continued)

OTHER PUBLICATIONS

Lorenzen et al. Front. Immunol. 13:1057375. doi: 10.3389/fimmu.2022.1057375, 2022.*
Kalayoglu, M.V., Byrne, G.I. (2006). The Genus *Chlamydia*—Medical. In: Dworkin, M., Falkow, S., Rosenberg, E., Schleifer, KH., Stackebrandt, E. (eds) The Prokaryotes. Springer, New York, NY. https://doi.org/10.1007/0-387-30747-8_30.*
Wolf et al. Infect Immun. May 2001, 69(5):3082-3091.*
Ackson et al. npj Vaccines (2020)5:11; https://doi.org/10.1038/s41541-020-0159-8.*
Sanofi, "Innovation to Drive Sustainable Growth in Vaccines", Vaccine investor Event, Jun. 29, 2023.

(Continued)

*Primary Examiner* — Oluwatosin A Ogunbiyi
(74) *Attorney, Agent, or Firm* — LATHROP GPM LLP; James H. Velema, Esq.; Michael J. Spellberg

(57) ABSTRACT

This invention relates to compositions (e.g., vaccine compositions) which can be used to immunise against *Chlamydia* infections. The compositions comprise *Chlamydia* sp. antigens and antigen combinations which can be used to immunise against *Chlamydia* sp., used in the form of nucleic acids (e.g., mRNAs) encoding antigenic proteins or in the form of recombinant protein antigens.

38 Claims, 39 Drawing Sheets
Specification includes a Sequence Listing.

(56) References Cited

U.S. PATENT DOCUMENTS

| | | | |
|---|---|---|---|
| 8,735,543 | B2 | 5/2014 | Andersson et al. |
| 8,889,142 | B2 | 11/2014 | Theisen et al. |
| 9,068,007 | B2 | 6/2015 | Zhong et al. |
| 9,125,864 | B2 | 9/2015 | Grifantini et al. |
| 9,259,463 | B2 | 2/2016 | Caldwell et al. |
| 9,308,248 | B2 | 4/2016 | Vanrompay et al. |
| 9,512,073 | B2 | 12/2016 | Dong et al. |
| 9,669,089 | B2 | 6/2017 | Thess et al. |
| 9,987,345 | B2 | 6/2018 | Grifantini et al. |
| 9,987,346 | B2 | 6/2018 | Massari et al. |
| 10,039,823 | B2 | 8/2018 | Vandepapeliere et al. |
| 10,143,745 | B2 | 12/2018 | Vandepapeliere et al. |
| 10,201,618 | B2 | 2/2019 | Anderson et al. |
| 10,202,617 | B2 | 2/2019 | Balraj et al. |
| 10,420,829 | B2 | 9/2019 | Caldwell et al. |
| 10,835,594 | B2 | 11/2020 | Mahony et al. |
| 10,925,954 | B2 | 2/2021 | Follmann et al. |
| 2006/0073531 | A1 | 4/2006 | Mitchell et al. |
| 2008/0166376 | A1 | 7/2008 | Brunham et al. |
| 2010/0172927 | A1 | 7/2010 | Alderson et al. |
| 2011/0244026 | A1 | 10/2011 | Guild et al. |
| 2011/0245776 | A1 | 10/2011 | Kendall |
| 2012/0135039 | A1 | 5/2012 | Aldwell et al. |
| 2013/0045181 | A1 | 2/2013 | Zhong |
| 2014/0275478 | A1* | 9/2014 | Follmann ............ C07K 14/295 530/324 |
| 2016/0032356 | A1 | 2/2016 | Heartlein et al. |
| 2016/0151409 | A1 | 6/2016 | Derosa et al. |
| 2016/0166710 | A1 | 6/2016 | Baumhof |
| 2016/0235864 | A1 | 8/2016 | Schlake et al. |
| 2016/0304883 | A1 | 10/2016 | Grund et al. |
| 2016/0038432 | A1 | 12/2016 | Kass et al. |
| 2017/0029847 | A1 | 2/2017 | Thess |
| 2018/0125989 | A1 | 5/2018 | Derosa et al. |
| 2018/0153822 | A1 | 6/2018 | Karve et al. |
| 2018/0263641 | A1 | 9/2018 | Crichton et al. |
| 2018/0264244 | A1 | 9/2018 | Meliga et al. |
| 2018/0289792 | A1 | 10/2018 | Ciaramella et al. |
| 2019/0083602 | A1 | 3/2019 | Roos et al. |
| 2020/0179501 | A1 | 6/2020 | Galen et al. |
| 2020/0246450 | A1 | 8/2020 | Junger et al. |
| 2021/0085598 | A1 | 3/2021 | Kosuda et al. |
| 2021/0106668 | A1 | 4/2021 | Cherpes et al. |
| 2022/0143376 | A1 | 5/2022 | Forster |
| 2022/0339416 | A1 | 10/2022 | Kosuda et al. |
| 2023/0270842 | A1 | 8/2023 | Schrader et al. |

FOREIGN PATENT DOCUMENTS

| | | |
|---|---|---|
| WO | WO 1995/012411 A1 | 5/1995 |
| WO | WO 1995/017209 A1 | 6/1995 |
| WO | WO 1995/017210 A1 | 6/1995 |
| WO | WO 1997/006263 A1 | 2/1997 |
| WO | WO 1997/044446 A1 | 11/1997 |
| WO | WO 1998/028005 A1 | 7/1998 |
| WO | WO 2002/008267 A2 | 1/2001 |
| WO | WO 2002/014516 A1 | 2/2002 |
| WO | WO 2002/062380 A2 | 8/2002 |
| WO | WO 2003/068811 A2 | 8/2003 |
| WO | WO 2005/113782 A1 | 12/2005 |
| WO | WO 2006/128296 A1 | 12/2006 |
| WO | WO 2007/006939 A2 | 1/2007 |
| WO | WO 2007/068907 A2 | 6/2007 |
| WO | WO 2011/005799 A2 | 1/2011 |
| WO | WO 2012/065262 A1 | 5/2012 |
| WO | WO 2012/065263 A1 | 5/2012 |
| WO | WO 2014/146663 A1 | 9/2014 |
| WO | WO 2016/091391 A1 | 6/2016 |
| WO | WO 2016/174271 A1 | 11/2016 |
| WO | WO 2017/075653 A1 | 5/2017 |
| WO | WO 2017/162265 A1 | 9/2017 |
| WO | WO 2018/175875 A1 | 9/2018 |
| WO | WO 2018/204421 A2 | 11/2018 |
| WO | WO 2021/016430 A1 | 1/2021 |
| WO | WO 2022/090359 A1 | 6/2022 |
| WO | WO 2022/136508 A1 | 6/2022 |
| WO | WO 2023/056089 A1 | 4/2023 |

OTHER PUBLICATIONS

Partial European Search Report and Invitation to Pay Additional Fees and, Where Applicable, Protest Fee for PCT International Patent Application No. PCT/EP2024/055631, dated Jun. 24, 2024.

Baehr et al., "Mapping antigenic domains expressed by *Chlamydia trachomatis* major outer membrane protein genes", PNAS, Jun. 1, 1988, 85(11): 4000-4004.

Brunham et al., "The epidemiology of *Chlamydia trachomatis* within a sexually transmitted diseases core group", J. Infect. Dis., Apr. 1, 1996, 173(4): 950-956.

Budker et al., "Protein/Amphipathic Polyamine Complexes Enable Highly Efficient Transfection with Minimal Toxicity", BioTechniques, Jul. 1997, 23(1): 139-147.

Caldwell et al., "Purification and partial characterization of the major outer membrane protein of *Chlamydia trachomatis*", Infection and Immunity, Mar. 1981, 31(3): 1161-1176.

Caldwell et al., "Neutralization of *Chlamydia trachomatis* infectivity with antibodies to the major outer membrane protein", Infection and Immunity, Nov. 1982, 38(2): 745-754.

Cohen et al., "Immunoepidemiologic profile of *Chlamydia trachomatis* infection: importance of heat-shock protein 60 and interferon-gamma", J. Infect. Dis., Aug. 15, 2005, 192(4): 591-599.

Collar et al., "Antibodies to Variable Domain 4 Linear Epitopes of the *Chlamydia trachomatis* Major Outer Membrane Protein Are Not Associated with *Chlamydia* Resolution or Reinfection in Women", mSphere, Sep. 23, 2020, 5(5): e00654-20.

Cotter et al., "Protective efficacy of major outer membrane protein-specific immunoglobulin A (IgA) and IgG monoclonal antibodies in a murine model of *Chlamydia trachomatis* genital tract infection", Infection and Immunity, Dec. 1, 1995, 63(12): 4704-4714.

Darville et al., "Anti-*Chlamydia* IgG and IgA are insufficient to prevent endometrial *Chlamydia* infection in women, and increased anti-*Chlamydia* IgG is associated with enhanced risk for incident infection", Am. J. Reprod. Immunol., May 2019, 81(5): e13103.

De La Maza et al., "*Chlamydia trachomatis* vaccines for genital infections: where are we and how far is there to go?", Expert Review of Vaccines, Apr. 2021, 20(4), 421-435.

Dong et al., "Lipopeptide nanoparticles for potent and selective siRNA delivery in rodents and nonhuman primates," PNAS, Feb. 10, 2014, 111(11): 3955-3960.

Extended European Search Report for European Patent Application No. 23306372.6, dated Feb. 13, 2024.

Fadel et al., "*Chlamydia trachomatis* OmcB protein is a surface-exposed glycosaminoglycan-dependent adhesin", J. Med. Microbiol., Jan. 2007, 56(1): 15-22.

Fenton et al., "Bioinspired Alkenyl Amino Alcohol Ionizable Lipid Materials for Highly Potent In Vivo mRNA Delivery", Adv. Mater., Apr. 20, 2016, 28(15): 2939-2943.

Finco et al., "Approach to discover T- and B-cell antigens of intracellular pathogens applied to the design of *Chlamydia trachomatis* vaccines", PNAS, Jun. 14, 2011, 108(24): 9969-9974.

Fitch et al., "Phylogenetic analysis of the outer-membrane-protein genes of Chlamydiae, and its implication for vaccine development", Mol. Biol. Evol., Jul. 1, 1993, 10(4): 892-913.

Gao et al., "A novel cationic liposome reagent for efficient transfection of mammalian cells", Biochem. Biophys. Res. Comm., Aug. 1, 1991, 179(1): 280-285.

Klibanov et al., "Amphipathic polyethyleneglycols effectively prolong the circulation time of liposomes", FEBS Letters, Jul. 30, 1990, 268(1): 235-237.

Liu et al., "Reduced Endometrial Ascension and Enhanced Reinfection Associated With Immunoglobulin G Antibodies to Specific *Chlamydia trachomatis* Proteins in Women at Risk for *Chlamydia*", J. Infect. Dis., Mar. 2, 2022, 225(5): 846-855.

Madico et al., "Structural and Immunological Characterization of Novel Recombinant MOMP-Based Chlamydial Antigens", Vaccines, Dec. 25, 2017, 6(2): 1-22.

(56) References Cited

OTHER PUBLICATIONS

Malhotra et al., "Genital *Chlamydia trachomatis*: an update", Indian J. Med. Res., Sep. 2013, 138(3): 303-316.

Markham et al., "Biophysical characterization of *Chlamydia trachomatis* CT584 supports its potential role as a type III secretion needle tip protein", Biochemistry, Nov. 3, 2009, 48(43): 10353-10361.

Morrison et al., "A predominant role for antibody in acquired immunity to chlamydial genital tract reinfection", J. Immunol., Dec. 1, 2005, 175(11): 7536-7542.

Murray et al., "*Chlamydia trachomatis*: Cell biology, immunology and vaccination", Vaccine, May 21, 2021, 39(22): 2965-2975.

Öhman et al., "Prevalence and persistence of *Chlamydia trachomatis*-specific antibodies after occasional and recurrent infections", Sex. Transm. Infect., Jun. 2020, 96(4): 277-282.

Olsen et al., "Protection against *Chlamydia* promoted by a subunit vaccine (CTH1) compared with a primary intranasal infection in a mouse genital challenge model", PLoS One, May 21, 2010, 5(5): e10768.

Olsen et al., "Characterization of protective immune responses promoted by human antigen targets in a urogenital *Chlamydia trachomatis* mouse model", Vaccine, Feb. 3, 2014, 32(6): 685-692.

Paes et al., "Recombinant polymorphic membrane protein D in combination with a novel, second-generation lipid adjuvant protects against intra-vaginal *Chlamydia trachomatis* infection in mice", Vaccine, Jul. 29, 2016, 34(35): 4123-4131.

Paes et al., "The *Chlamydia trachomatis* PmpD adhesin forms higher order structures through disulphide-mediated covalent interactions", PloS One, Jun. 18, 2018, 13(6), e0198662.

Peeling et al., "In vitro neutralization of *Chlamydia trachomatis* with monoclonal antibody to an epitope on the major outer membrane protein", Infection and Immunity, Nov. 1984, 46(2): 484-288.

Phillips et al., "Seventy Years of *Chlamydia* Vaccine Research—Limitations of the Past and Directions for the Future", Front. Microbiol., Jan. 31, 2019, 10:70.

Qi et al., "A *Chlamydia trachomatis* OmcB C-terminal fragment is released into the host cell cytoplasm and is immunogenic in humans", Infection and Immunity, Jun. 2011, 79(6): 2193-2203.

Russell et al., "Analysis of Factors Driving Incident and Ascending Infection and the Role of Serum Antibody in *Chlamydia trachomatis* Genital Tract Infection", J. Infect. Dis., Feb. 15, 2016, 213(4): 523-531.

Stephens et al., "Diversity of *Chlamydia trachomatis* major outer membrane protein genes", J Bacteriol., Sep. 1987, 169(9): 3879-3885.

Sun et al., "Structural and functional analyses of the major outer membrane protein of *Chlamydia trachomatis*", J. Bacteriol., Sep. 2007, 189(17): 6222-6235.

Witkin et al., "*Chlamydia trachomatis*: the Persistent Pathogen", Clin. Vaccine Immunol., Oct. 5, 2017, 4(10): e00203-e00217.

Zhang et al., "Protective monoclonal antibodies recognize epitopes located on the major outer membrane protein of *Chlamydia trachomatis*", J. Immunol., Jan. 15, 1987, 138(2): 575-581.

\* cited by examiner

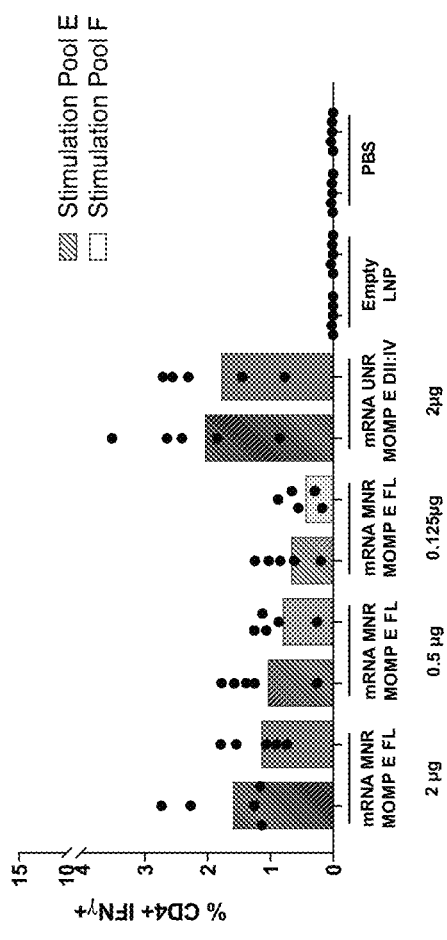
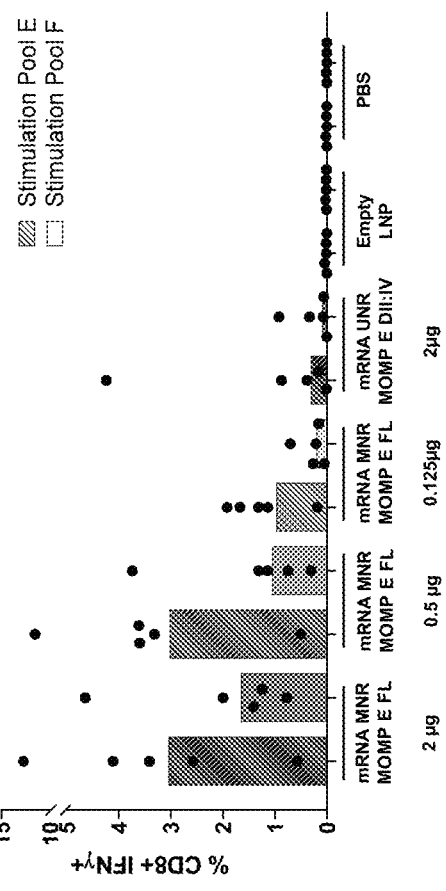
FIG. 2A
FIG. 2B

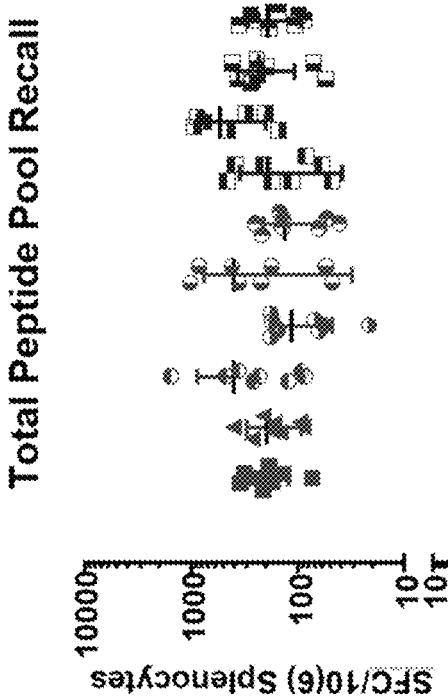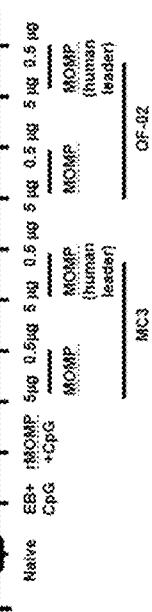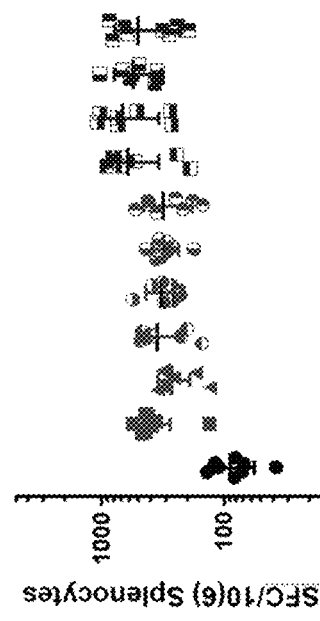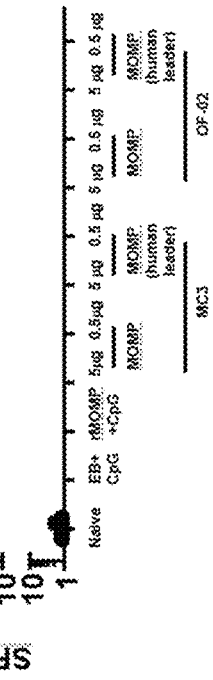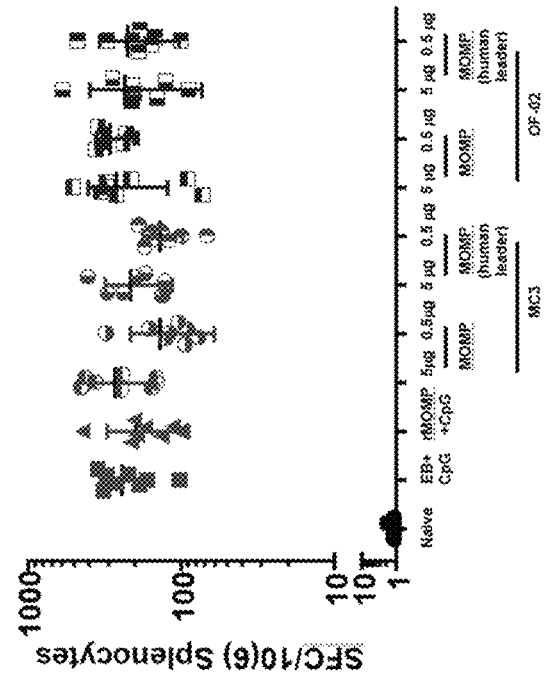

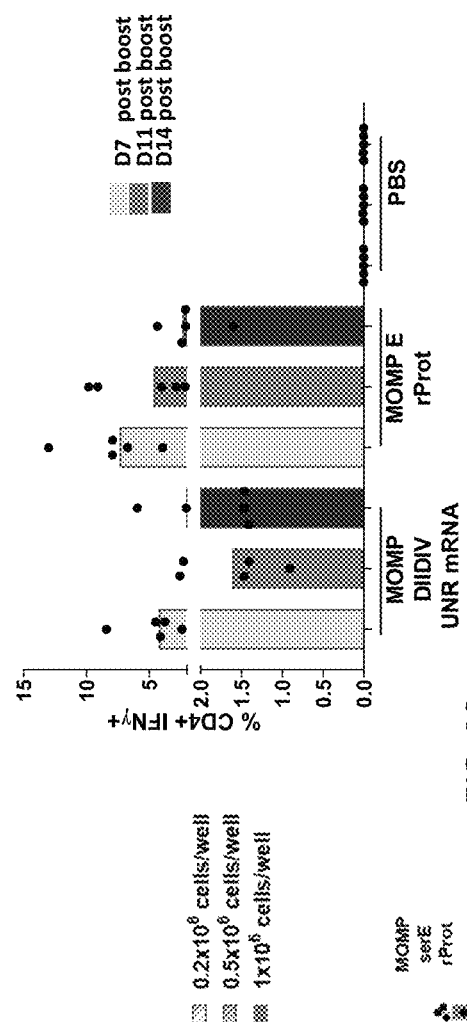
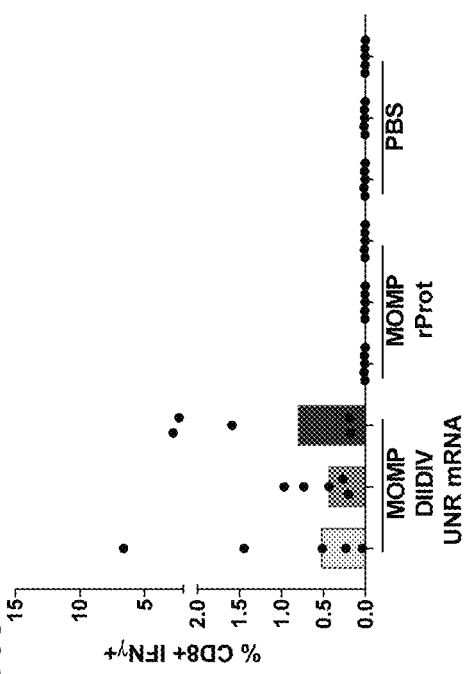
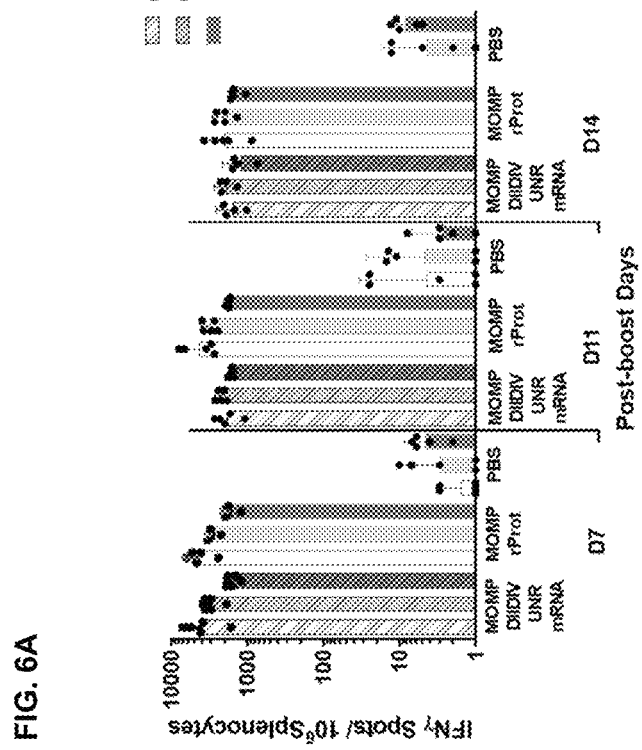
FIG. 6A
FIG. 6B
FIG. 6C

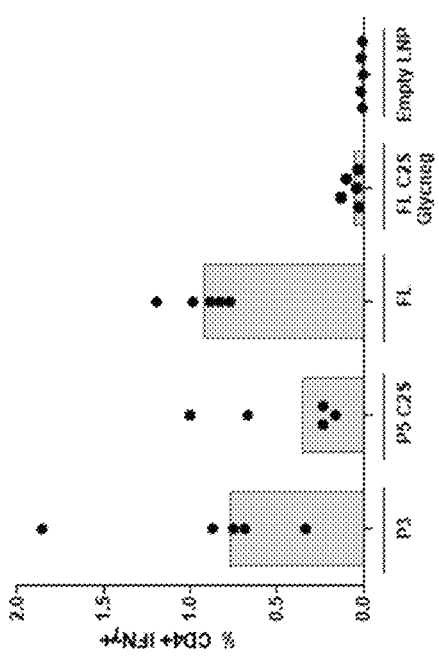
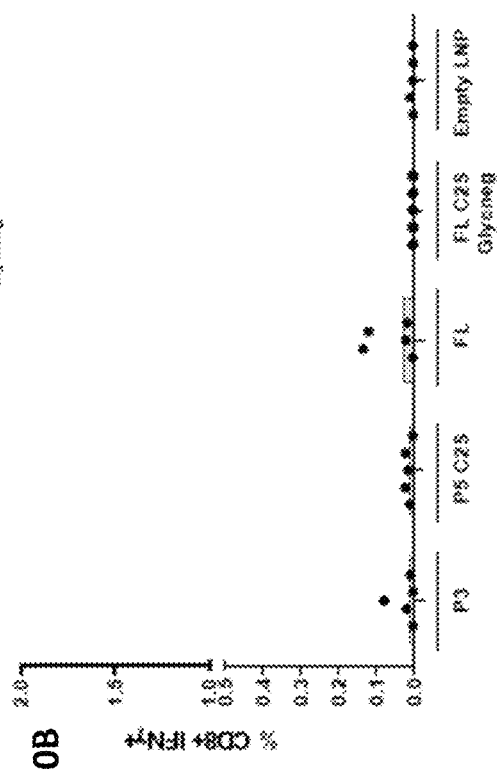
FIG. 10A
FIG. 10B

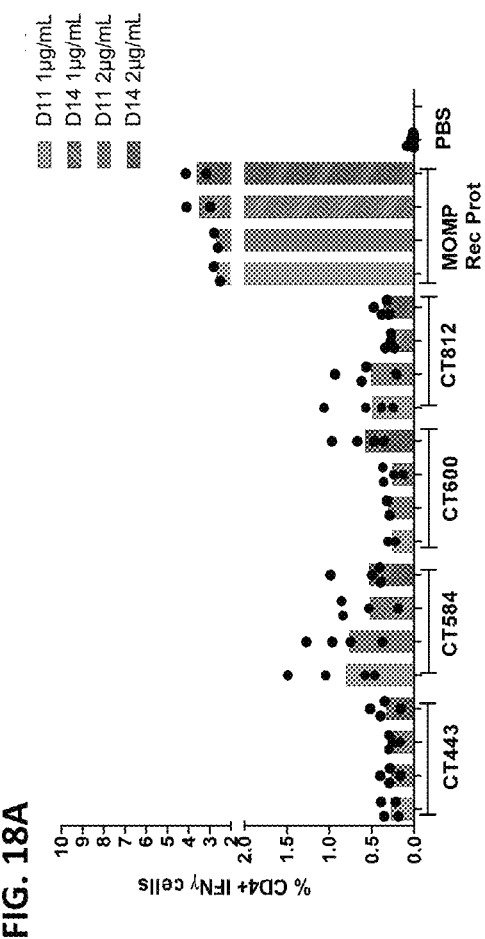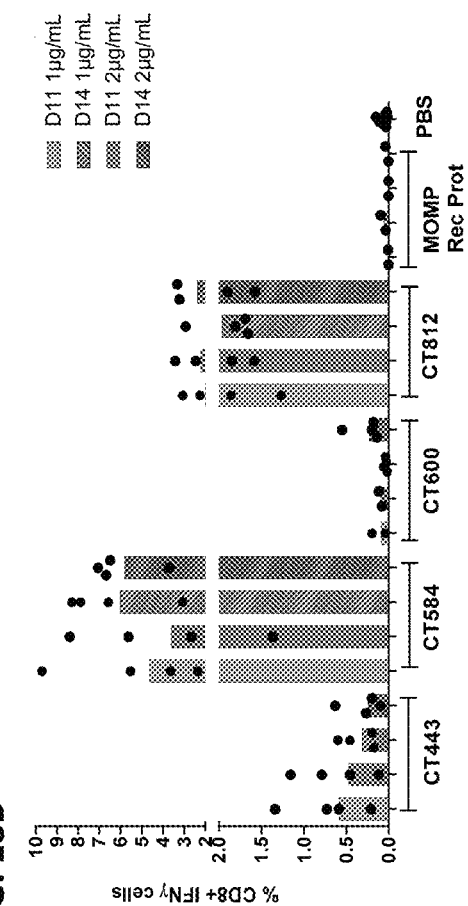
FIG. 18A
FIG. 18B

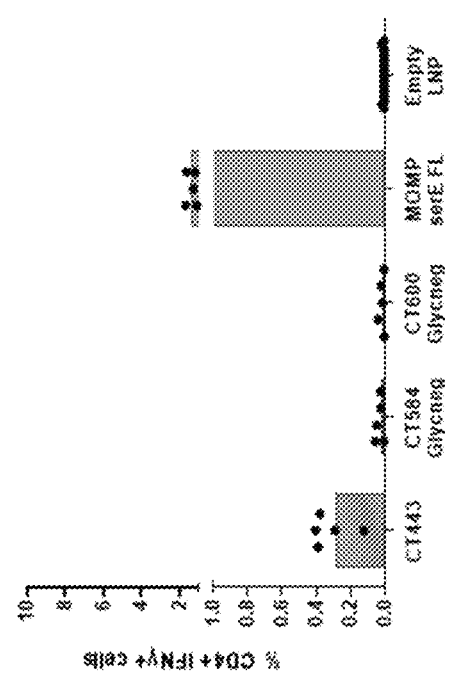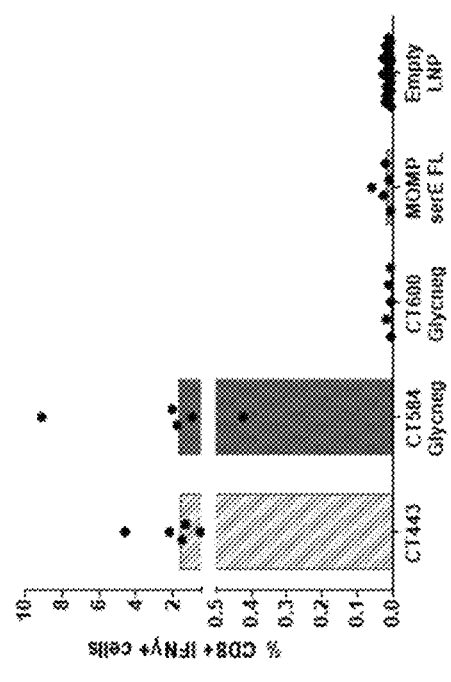

FIG. 28

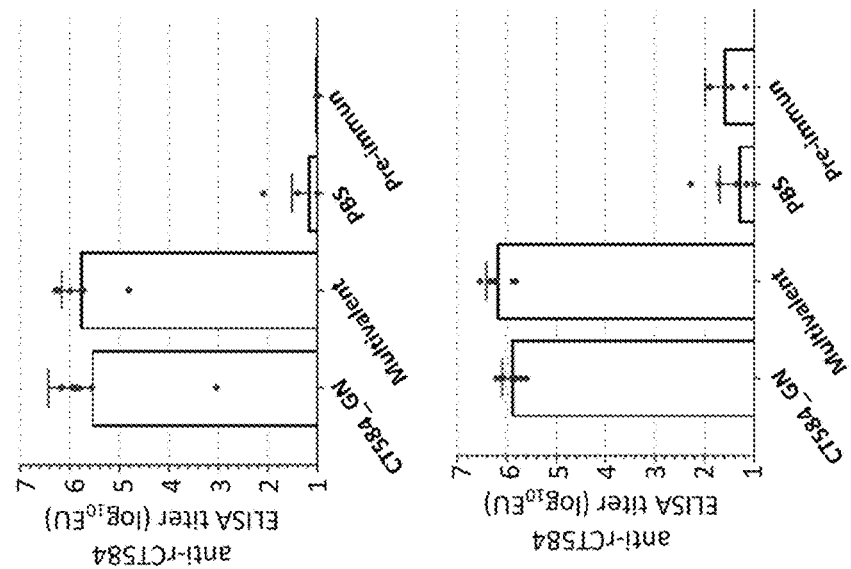
FIG. 39E  FIG. 39C  FIG. 39A
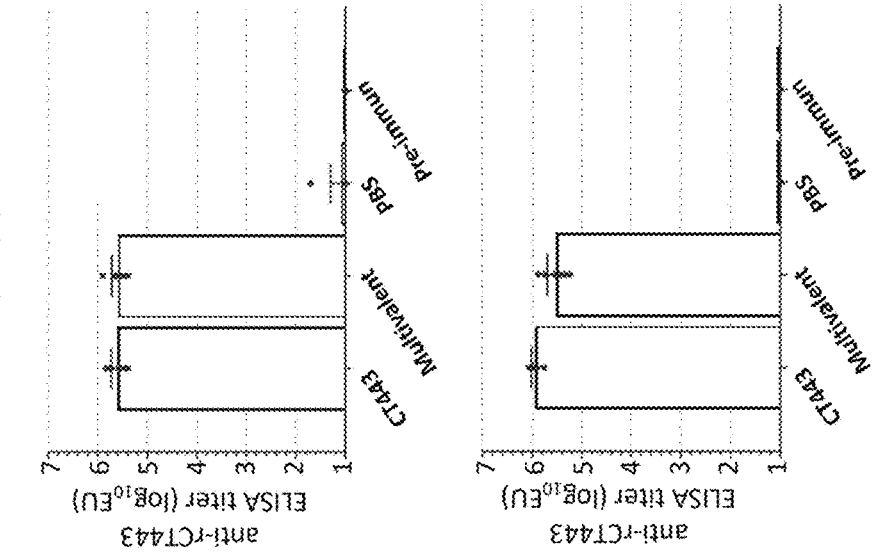
FIG. 39F  FIG. 39D  FIG. 39B
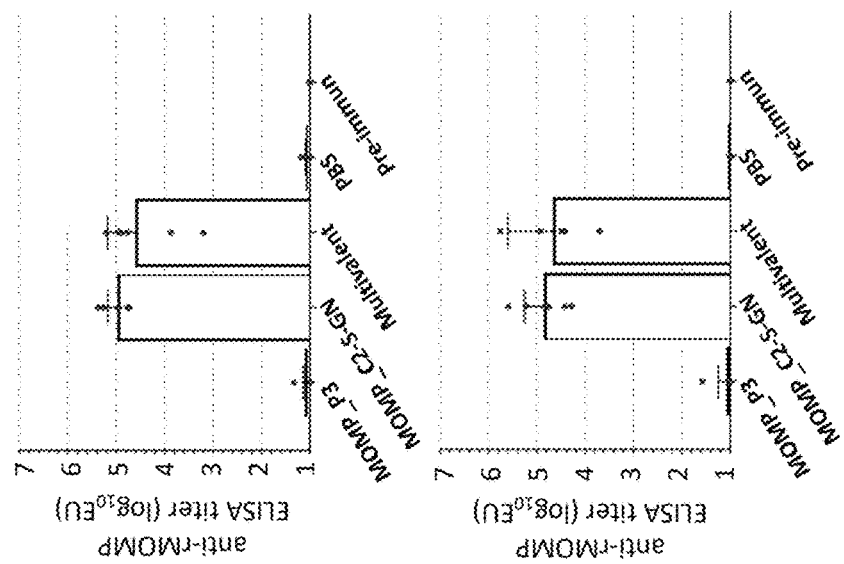

COMPOSITIONS FOR USE IN TREATMENT OF *CHLAMYDIA*

RELATED APPLICATIONS

This application claims the benefit of U.S. Provisional Patent Application Serial Nos. 63/449,571, filed Mar. 2, 2023, and 63/500,393, filed May 5, 2023, European Patent Application Nos. 23305375.0, filed Mar. 20, 2023, and 23306372.6, filed Aug. 11, 2023, the entire disclosures of which are hereby incorporated herein by reference.

SEQUENCE LISTING

The instant application contains a Sequence Listing which has been submitted electronically in XML format and is hereby incorporated by reference in its entirety. Said XML file, created on Mar. 4, 2024, is named 752233_SA9-373 ST26.xml and is 1,588,209 bytes in size.

FIELD OF THE INVENTION

The invention is in the field of treating and preventing *Chlamydia* infections. In particular, the invention relates to antigens and antigen combinations which can be used as vaccines to immunise against *Chlamydia* sp. infection. The vaccines may be delivered as nucleic acids (e.g., mRNAs) encoding antigenic proteins or as recombinant protein antigens.

BACKGROUND

Chlamydiae are intracellular bacterial pathogens responsible for a variety of infections, including the human sexually transmitted disease and eye infections (Trachoma) caused by *Chlamydia trachomatis*. The genus *Chlamydia* further comprises the species *Chlamydia abortus*, *Chlamydia pneumoniae*, *Chlamydia psittaci*, *Chlamydia pecorum*, *Chlamydia felis*, and *Chlamydia caviae*.

*Chlamydia trachomatis* (*C. trachomatis*) comprises three biovars which lead to an array of pathological conditions in humans, and which are further subdivided into serovars.[1] Serovars A-C (A, B, Ba, and C), of the trachoma biovar, can cause *Chlamydia* conjunctivitis or trachoma, a disease that can result in blindness.[2] Serovars D-K (D, E, F, G, H, I, J, and K), of the genital tract biovar, cause disease in the genital tract.[3] The lymphogranuloma venereum biovar, serovars L1-3 (L1, L2, and L3), causes invasive urogenital and anorectal infection and has become particularly associated with HIV-infected men who have sex with men.[4]

*C. trachomatis* (serovars D-K) is the most common bacterial agent of sexually transmitted infections.[5] In 2020, the WHO estimated 129 million new *C. trachomatis* infections. These are of public health concern particularly because untreated infections are often asymptomatic or with minimal symptoms, but they contribute to the transmission of the pathogen. Furthermore, if left untreated, the infection can, amongst others, lead to salpingitis, endometritis, pelvic inflammatory disease (PID), ectopic pregnancy, tubal factor infertility, and can increase the risk for the transmission or acquisition of HIV and the development of cervical carcinoma.[6] While *C. trachomatis* infections can be effectively controlled by antibiotic therapy, due to the high prevalence of cases and their frequently delayed diagnosis for asymptomatic cases, *C. trachomatis* has become a leading cause of female infertility worldwide.[7] There is a need for developing an effective *C. trachomatis* vaccine as a sustainable strategy to curb infection rates of *C. trachomatis*.

DISCLOSURE OF THE INVENTION

The present inventors have provided *Chlamydia* sp. antigens and antigen combinations which can be used to immunise against *Chlamydia* sp.

In particular, the inventors found that antigens derived from a native major outer membrane protein (MOMP) polypeptide of *Chlamydia trachomatis* and *C. trachomatis* antigens other than MOMP elicited robust T cell responses, particularly induction of IFN-γ-producing CD4+ T cells, and/or B cell (i.e. antibody) responses when delivered by mRNAs encoding the relevant antigens. In particular, T cell responses are considered critical for protective immunity.

Accordingly, the invention provides modified MOMP polypeptides, chimeric MOMP VD polypeptides and CT443, CT584, CT600 and CT812 *Chlamydia* sp. polypeptides and nucleic acids comprising a nucleotide sequence encoding such polypeptides.

Polypeptide antigens described herein may be delivered by, i.e. in the form of, a nucleic acid (e.g., mRNA) comprising a nucleotide sequence encoding said polypeptide.

MOMP

MOMP is an integral membrane porin protein[8] found in bacteria of *Chlamydia* sp. It makes up roughly 60% of the protein mass in the *Chlamydia trachomatis* membrane[9] and contains multiple B & T cell epitopes.[10] In *C. trachomatis* infection, MOMP is an immunodominant antigen. Native MOMP polypeptides of *Chlamydia* sp. include five conserved domains separated by four surface exposed variable domains (VD1, VD2, VD3 and VD4).[11,12] Thus, in a native MOMP polypeptide of *Chlamydia* sp., VD1, VD2, VD3 and VD4 are surface exposed loops. Within *Chlamydia* species (e.g., *C. trachomatis*), native MOMP polypeptides vary in their VD sequences across different serovars.[13,14] Within each serovar of *C. trachomatis*, native MOMP polypeptide sequences are highly conserved with greater than 98% sequence identity. Across serovars of *C. trachomatis*, the protein sequences are highly conserved, with exception of the surface exposed VDs. Neutralising antibody epitopes have been mapped to VDs.[15,1,17,18,19]

The inventors have recognised that IFN-γ producing CD4+ T cells are critical for protective immunity; indeed cellular IFN-γ production has been shown to strongly correlate with protection[20] and CD4+ T cells appear to be critical since HIV+ women are at increased risk for *Chlamydia* reinfection[21]. There is also evidence that *C. trachomatis* antibodies (i.e. B cell-mediated responses) alone may not prevent reinfection and the presence of anti-*C. trachomatis* IgG may even enhance the risk for incident infection.[22] Anti-*C. trachomatis* antibodies have been shown to accelerate clearance of a primary *C. trachomatis* challenge in the presence of CD4+ T cells in mice, however, in the absence of CD4+ T cells, the primary challenge was not cleared.[23]

A "native *Chlamydia* sp. MOMP polypeptide" as used herein encompasses a mature form of a full-length native MOMP polypeptide of a *Chlamydia* sp. without its native signal peptide sequence and a full-length native MOMP polypeptide of a *Chlamydia* sp. including its native signal peptide sequence. In exemplary embodiments, the *Chlamydia* sp. referred to herein is *Chlamydia trachomatis*. A native *C. trachomatis* MOMP polypeptide may be of one of serovars A-C, D-K or L1-L3, e.g., serovars D-K. In some embodiments, the native *C. trachomatis* MOMP polypeptide is of one of serovars D-G. In some exemplary embodiments, the native *C. trachomatis* MOMP polypeptide is of serovar E. Exemplary sequences of native *Chlamydia* sp. MOMP polypeptides comprising the native signal peptide sequence are provided by SEQ ID NOs 1-4.

The amino acid sequence of a native *C. trachomatis* MOMP polypeptide of serovar E is provided in SEQ ID NO: 2:

```
                                          (SEQ ID NO: 2)
MKKLLKSVLV  FAALSSASSL  QALPVGNPAE

PSLMIDGILW  EGFGGDPCDP  CTTWCDAISM

RMGYYGDFVF  DRVLKTDVNK  EFQMGDKPTS

TTGNATAPTT  LTARENPAYG  RHMQDAEMFT

NAACMALNIW  DRFDVFCTLG  ASSGYLKGNS

ASFNLVGLFG  DNENQSTVKT  NSVPNMSLDQ

SVVELYTDTA  FSWSVGARAA  LWECGCATLG

ASFQYAQSKP  KVEELNVLCN  AAEFTINKPK

GYVGQEFPLA  LIAGTDAATG  TKDASIDYHE

WQASLALSYR  LNMFTPYIGV  KWSRASFDAD

TIRIAQPKSA  TAIFDTTTLN  PTIAGAGDVK

ASAEGQLGDT  MQIVSLQLNK  MKSRKSCGIA

VGTTIVDADK  YAVTVETRLI  DERAAHVNAQ

FRF
```

The native signal peptide sequence corresponds to residues 1-22 in the amino acid sequence of MOMP of *C. trachomatis* serovar E (SEQ ID NO: 2) and is shown underlined. Residues 23-393 of SEQ ID NO: 2 correspond to the mature form of full-length native MOMP polypeptide of serovar E of *C. trachomatis* which lacks the native signal peptide sequence. VD1-VD4 sequences of the MOMP polypeptide of serovar E of *C. trachomatis* are shown in bold and underlined text above.

A native *Chlamydia* sp. MOMP polypeptide may comprise the sequence of:
(i) a native MOMP polypeptide of serovar D of *C. trachomatis* (SEQ ID NO: 1) or its mature form (residues 23-393 of SEQ ID NO: 1);
(ii) a native MOMP polypeptide of serovar F of *C. trachomatis*, (SEQ ID NO: 3), or its mature form (residues 23-395 of SEQ ID NO: 3); or
(iii) a native MOMP polypeptide of serovar G of *C. trachomatis* (SEQ ID NO: 4) or its mature form (residues 23-395 of SEQ ID NO: 4).

A native *Chlamydia* sp. MOMP polypeptide comprises five conserved domains separated by four variable surface exposed domains (VD1, VD2, VD3 and VD4). For example, in the native MOMP polypeptide of *C. trachomatis* serovar E, VD1 (SEQ ID NO: 9) corresponds to amino acid residues 86-105 of SEQ ID NO: 2, VD2 (SEQ ID NO: 10) corresponds to amino acid residues 161-181 of SEQ ID NO: 2, VD3 (SEQ ID NO: 11) corresponds to amino acid residues 245-260 of SEQ ID NO: 2, and VD4 (SEQ ID NO: 12) corresponds to amino acid residues 309-337 of SEQ ID NO: 2. Conserved domains correspond to amino acid residues 23-85 (first conserved domain); 106-160 (second conserved domain); 182-244 (third conserved domain), 261-308 (fourth conserved domain) and 338-393 (fifth conserved domain). For serovar E, either VD4 (SEQ ID NO: 12) corresponds to positions 309-337 in SEQ ID NO: 2 and the fifth conserved domain corresponds to positions 338-393 in SEQ ID NO: 2 or VD4 (SEQ ID NO: 883) corresponds to positions 309-338 in SEQ ID NO: 2 and the fifth conserved domain corresponds to positions 339-393 in SEQ ID NO: 2.

For serovars D, F and G of *C. trachomatis*, the residues corresponding to VD1, VD2, VD3 and VD4 and the five conserved domains are set out in Table 1. For serovar D, either VD4 (SEQ ID NO: 8) corresponds to positions 309-337 in SEQ ID NO: 1 and the fifth conserved domain corresponds to positions 338-393 in SEQ ID NO: 1 or VD4 (SEQ ID NO: 882) corresponds to positions 309-338 in SEQ ID NO: 1 and the fifth conserved domain corresponds to positions 339-393 in SEQ ID NO: 1. For serovar F, either VD4 (SEQ ID NO: 16) corresponds to positions 310-339 in SEQ ID NO: 3 and the fifth conserved domain corresponds to positions 340-395 in SEQ ID NO: 3 or VD4 (SEQ ID NO: 884) corresponds to positions 310-340 in SEQ ID NO: 3 and the fifth conserved domain corresponds to positions 341-395 in SEQ ID NO: 3. For serovar G, either VD4 (SEQ ID NO: 20) corresponds to positions 310-339 in SEQ ID NO: 4 and the fifth conserved domain corresponds to positions 340-395 in SEQ ID NO: 4 or VD4 (SEQ ID NO: 885) corresponds to positions 310-340 in SEQ ID NO: 4 and the fifth conserved domain corresponds to positions 341-395 in SEQ ID NO: 4.

TABLE 1

VD1-VD4 and the first, second, third, fourth and fifth conserved domain in a native MOMP polypeptide of *C. trachomatis* serovars, D-G.

| Serovar | Domain | Positions in SEQ ID NO: | SEQ ID NOs |
|---|---|---|---|
| D | First conserved domain | 23-85 in SEQ ID NO: 1 | |
| | VD1 | 86-105 in SEQ ID NO: 1 | 5 |
| | Second conserved domain | 106-160 in SEQ ID NO: 1 | |
| | VD2 | 161-181 in SEQ ID NO: 1 | 6 |
| | Third conserved domain | 182-244 in SEQ ID NO: 1 | |
| | VD3 | 245-260 in SEQ ID NO: 1 | 7 |
| | Fourth conserved domain | 261-308 in SEQ ID NO: 1 | |
| Either | VD4 | 309-337 in SEQ ID NO: 1 | 8 |
| | Fifth conserved domain | 338-393 in SEQ ID NO: 1 | |
| Or | VD4 | 309-338 in SEQ ID NO: 1 | 882 |
| | Fifth conserved domain | 339-393 in SEQ ID NO: 1 | |
| E | First conserved domain | 23-85 in SEQ ID NO: 2 | |
| | VD1 | 86-105 in SEQ ID NO: 2 | 9 |
| | Second conserved domain | 106-160 in SEQ ID NO: 2 | |
| | VD2 | 161-181 in SEQ ID NO: 2 | 10 |
| | Third conserved domain | 182-244 in SEQ ID NO: 2 | |
| | VD3 | 245-260 in SEQ ID NO: 2 | 11 |
| | Fourth conserved domain | 261-308 in SEQ ID NO: 2 | |
| Either | VD4 | 309-337 in SEQ ID NO: 2 | 12 |
| | Fifth conserved domain | 338-393 in SEQ ID NO: 2 | |
| Or | VD4 | 309-338 in SEQ ID NO: 2 | 883 |
| | Fifth conserved domain | 339-393 in SEQ ID NO: 2 | |
| F | First conserved domain | 23-85 in SEQ ID NO: 3 | |
| | VD1 | 86-106 in SEQ ID NO: 3 | 13 |
| | Second conserved domain | 107-161 in SEQ ID NO: 3 | |
| | VD2 | 162-182 in SEQ ID NO: 3 | 14 |
| | Third conserved domain | 183-245 in SEQ ID NO: 3 | |
| | VD3 | 246-261 in SEQ ID NO: 3 | 15 |
| | Fourth conserved domain | 262-309 in SEQ ID NO: 3 | |
| Either | VD4 | 310-339 in SEQ ID NO: 3 | 16 |
| | Fifth conserved domain | 340-395 in SEQ ID NO: 3 | |

TABLE 1-continued

VD1-VD4 and the first, second, third, fourth
and fifth conserved domain in a native MOMP polypeptide
of *C. trachomatis* serovars, D-G.

| Serovar | Domain | Positions in SEQ ID NO: | SEQ ID NOs |
|---|---|---|---|
| Or | VD4 | 310-340 in SEQ ID NO: 3 | 884 |
| | Fifth conserved domain | 341-395 in SEQ ID NO: 3 | |
| G | First conserved domain | 23-85 in SEQ ID NO: 4 | |
| | VD1 | 86-106 in SEQ ID NO: 4 | 17 |
| | Second conserved domain | 107-161 in SEQ ID NO: 4 | |
| | VD2 | 162-182 in SEQ ID NO: 4 | 18 |
| | Third conserved domain | 183-245 in SEQ ID NO: 4 | |
| | VD3 | 246-261 in SEQ ID NO: 4 | 19 |
| | Fourth conserved domain | 262-309 in SEQ ID NO: 4 | |
| Either | VD4 | 310-339 in SEQ ID NO: 4 | 20 |
| | Fifth conserved domain | 340-395 in SEQ ID NO: 4 | |
| Or | VD4 | 310-340 in SEQ ID NO: 4 | 885 |
| | Fifth conserved domain | 341-395 in SEQ ID NO: 4 | |

Native *C. trachomatis* MOMP polypeptides of serovars A-C, H-K, or L1-L3, or other native *Chlamydia* sp. MOMP polypeptides comprise VD1-VD4 and conserved domains at positions corresponding to the residue numbering set out for the native MOMP polypeptides of serovars D-G of *C. trachomatis*, e.g., serovar E.

The sequences of other native *Chlamydia* sp. MOMP polypeptides, including those of *C. trachomatis* MOMP polypeptides of serovars A-C, H-K, or L1-L3 are well known and available from public databases. For example, amino acid sequences of native *Chlamydia* sp. MOMP polypeptides are available on the Uniprot (uniprot.org/) and NCBI (ncbi.nlm.nih.gov/) databases. Nucleic acid sequences encoding native *Chlamydia* sp. MOMP polypeptides may be obtained from the NCBI (ncbi.nlm.nih.gov/) database. The positions of VDs and conserved domains within other native *Chlamydia* sp. MOMP polypeptides are well known and in any event can be determined by aligning sequences of e.g., *C. trachomatis* serovars D, E, F, and G with sequences of other native *Chlamydia* sp. MOMP polypeptides and looking for regions of high sequence conservation to identify e.g., conserved domains.

Modified MOMP Polypeptides

The inventors have generated modified MOMP polypeptides comprising non-native loop sequences instead of native *Chlamydia* sp. MOMP VD sequences. The inventors have recognised that such modified MOMP polypeptides can be used to elicit a protective immune response against *Chlamydia* sp. infection. In particular, the inventors have demonstrated that such modified MOMP polypeptides induce a T cell response, including CD4+ T cells such as IFNγ-producing CD4+ T cells. Notably, IFN-γ producing CD4+ T cells are thought to be important in protecting against *Chlamydia* sp. infections. Elimination of native VD sequences may therefore reduce B cell-mediated (e.g., antibody) responses (e.g., to B cell epitopes in VDs), while prioritising T cell responses to MOMP, e.g., to sequences in the conserved domains which are conserved between serovars. The inventors have shown that modified MOMP polypeptides can elicit a cross-serovar T cell immune response, i.e., a T cell immune response that is cross-reactive against two or more serovars of *Chlamydia* sp., e.g., serovars D-G and J of *C. trachomatis*.

The inventors have therefore demonstrated that these modified MOMP polypeptides are suitable vaccine candidates that may be used either as stand-alone antigens or in combination with other *Chlamydia* sp. antigens that can elicit B cell-mediated (e.g., antibody) responses and/or T cell-mediated responses in a subject, such as one or more chimeric MOMP VD polypeptides provided herein and/or one or more *Chlamydia* sp. CT443, CT584, CT600, or CT812 polypeptides provided herein, in order to promote long-lasting memory T cell responses and protective immunity against infection. A modified MOMP polypeptide as described herein may be delivered by a nucleic acid comprising a nucleotide sequence encoding the modified MOMP polypeptide.

Accordingly, in one aspect, the invention provides a nucleic acid comprising a nucleotide sequence encoding a modified MOMP polypeptide, wherein the modified MOMP polypeptide has an amino acid sequence comprising two or more conserved domain sequences of a native *Chlamydia* sp. MOMP polypeptide and a non-native loop sequence between the conserved domain sequences. In a further aspect, the invention provides a modified MOMP polypeptide having an amino acid sequence comprising two or more conserved domain sequences of a native *Chlamydia* sp. MOMP polypeptide and a non-native loop sequence between the conserved domain sequences.

In an exemplary embodiment, the modified MOMP polypeptide does not comprise a native *Chlamydia* sp. MOMP variable domain between the two or more conserved domain sequences. Thus, in a modified MOMP polypeptide, a non-native loop sequence may replace a native *Chlamydia* sp. MOMP polypeptide VD sequence. A modified MOMP polypeptide may therefore omit a native *Chlamydia* sp. MOMP VD sequence between the two or more conserved domain sequences and include a non-native loop sequence between the two or more conserved domain sequences.

Replacing native *Chlamydia* sp. MOMP VD sequences with non-native loops removes B cell epitopes (e.g., antibody epitopes) found in the native *Chlamydia* sp. MOMP VDs. Removal of these B cell epitopes may reduce B cell-mediated responses to the antigen in a subject (e.g., to B cell epitopes in native MOMP VDs). This may advantageously increase T cell responses to MOMP in a subject, e.g., to sequences in the MOMP conserved domains which share a high degree of identity between MOMP serovars. The modified MOMP polypeptides of the invention may therefore elicit a cross-serovar T cell immune response in a subject, i.e. a T cell immune response that is cross-reactive against two or more serovars of *Chlamydia* sp. (e.g., cross-reactive against two or more serovars (e.g., serovars D-G and J) of *C. trachomatis*). Thus, the modified MOMP polypeptides of the invention may be capable of enhancing T cell-mediated responses (e.g., relative to a corresponding native MOMP polypeptide). The modified MOMP polypeptides of the invention may be capable of enhancing a CD4+ T cell-mediated response (e.g., a IFNγ+CD4+ T cell response such as IFNγ+ IL2+ TNFα+ CD4+ T cell response) e.g., relative to a corresponding native MOMP polypeptide.

The modified MOMP polypeptides of the invention may be capable of inducing a T cell response (e.g., an antigen specific T cell response) in a subject. The T cell response may be immunodominant. Thus, the modified MOMP polypeptide of the invention may be capable of eliciting a T cell population responsive to a native *Chlamydia* sp. MOMP polypeptide in a subject. In some embodiments, the T cell response is a CD4+ T cell response (e.g., IFNγ+CD4+ T cell response). In some embodiments, the T cell response is a IFNγ+ IL2+ TNFα+ CD4+ T cell response.

"Non-native loop sequences" refer to sequences that are not native to any *Chlamydia* sp. MOMP VD (VD1, VD2, VD3 or VD4) of any serovar. In some embodiments, non-native loop sequences are no more than 40%, no more than 35%, no more than 30%, no more than 25%, no more than 20%, no more than 15%, no more than 10% or no more than 5% identical to any native *Chlamydia* sp. MOMP VD (VD1, VD2, VD3 or VD4) sequences of any serovar. In some embodiments, non-native loop sequences are no more than 40%, no more than 35%, no more than 30%, no more than 25%, no more than 20%, no more than 15%, no more than 10% or no more than 5% identical to MOMP VD sequences (VD1, VD2, VD3 or VD4) of serovar E of *C. trachomatis* (SEQ ID Nos: 9-12).

Non-native loop sequences may allow the conserved domain sequences in the modified MOMP polypeptide to form a beta-barrel structure, e.g., to maintain a beta-barrel structure of the conserved domains of a native *Chlamydia* sp. MOMP polypeptide. Thus, in the modified MOMP polypeptides of the invention, the two or more conserved domain sequences are linked by a non-native loop sequence such that the conserved domain sequences form a beta-barrel structure (e.g., made up of anti-parallel beta strands). The beta-barrel structure may be as predicted in silico (e.g., using Alphafold2 (Deepmind) software).

In silico modelling may be used to create a 3D structure of a native MOMP protein, which comprises a beta barrel with VD1-VD4 sequences as loops linking individual beta strands. The VD1-VD4 loops are located on the same side of the barrel structure (surface exposed in a native MOMP polypeptide). Non-native loop sequences may be mapped onto VD loops in an in silico model and suitable non-native loop sequences may be determined by the skilled person. Suitable non-native loop sequences include peptide sequences that can cover the distance between the ends of the conserved domains flanking a native VD, e.g., as modelled in silico. The distance may correspond to the distance in e.g., angstrom as determined by in silico 3D model between the last conserved domain residue before the VD sequence to the first conserved domain residue after the VD sequence.

Non-native loop sequences may exclude sequence motifs that are found in a subject (e.g., human) proteome, e.g., sequence motifs of 8 or more, 9 or more, 10 or more, 11 or more, 12 or more, 13 or more, 14 or more or 15 or more amino acids in length. Excluded subject proteome (e.g., human proteome) sequence motifs are typically 8 or more amino acids in length. This helps minimise unwanted cross-reactivity due to homology between the antigen and self protein.

A non-native loop sequence may be between 3 and 30 amino acids in length, e.g., between 4 and 20 amino acids in length. In some embodiments, a non-native loop sequence replacing VD1 may have a sequence according to SEQ ID NO: 462 or 466 (e.g., SEQ ID NO: 462). In some embodiments, a non-native loop sequence replacing VD2 may have a sequence according to SEQ ID NO: 463 or 467 (e.g., SEQ ID NO: 463). In some embodiments, a non-native loop sequence replacing VD3 may have a sequence according to SEQ ID NOs 464 or 468 (e.g., SEQ ID NO: 464). In some embodiments, a non-native loop sequence replacing VD4 may have a sequence according to SEQ ID NO: 465 or 469 (e.g., SEQ ID NO: 465). Typically, a modified MOMP polypeptide may comprise four non-native loop sequences according to SEQ ID NOs 462-465 in place of VD1, VD2, VD3 and VD4, respectively. A modified MOMP polypeptide may alternatively comprise four non-native loop sequences according to SEQ ID NOs 466-469 in place of VD1, VD2, VD3 and VD4, respectively.

A "conserved domain sequence of a native *Chlamydia* sp. MOMP polypeptide" refers to a sequence of a conserved domain of a MOMP polypeptide of a *Chlamydia* species of any serovar, or a variant thereof. Variants include sequences having at least 85%, at least 86%, at least 87%, at least 88%, at least 89%, at least 90%, at least 91%, at least 92%, at least 93%, at least 94%, at least 95%, at least 96%, at least 97%, at least 98% or at least 99% identity (e.g., at least 95% identity) to a conserved domain of a MOMP polypeptide of a *Chlamydia* sp. of any serovar. In some embodiment, the conserved domain sequences of the modified MOMP polypeptide is at least 90%, at least 91%, at least 92%, at least 93%, at least 94%, at least 95%, at least 96%, at least 97%, at least 98% or at least 99% identical (at least 95% identical) a conserved domain of a native MOMP polypeptide of a *Chlamydia* sp. of any serovar (e.g., a conserved domain as defined in Table 1). Variants also include truncated forms of native conserved domains of a MOMP polypeptide of a *Chlamydia* sp., for example wherein a conserved domain sequence in a modified MOMP polypeptide lacks up to 3, 5, 8, 10, 15, 20, 25 or 30 (e.g., up to 3 or 5, e.g., up to 3) amino acids of a native *Chlamydia* sp. MOMP conserved domain sequence. In some embodiments, the conserved domain sequences of the modified MOMP polypeptide lack up to 3 or 5 amino acids of a native *Chlamydia* sp. MOMP conserved domain sequence. The conserved domain boundaries for *C. trachomatis* serovars D, E, F and G are set out in Table 1.

In some embodiments, the modified MOMP polypeptide comprises two, three, four or five conserved domains of a native *Chlamydia* sp. MOMP polypeptide, or variants thereof. In some embodiments, a modified MOMP polypeptide comprises five conserved domain sequences of a native *Chlamydia* sp. MOMP polypeptide, or variants thereof. In some embodiments, the modified MOMP polypeptide comprises all five full-length conserved domains of a native *Chlamydia* sp. MOMP polypeptide. The conserved domains of the modified MOMP polypeptide may collectively have at least 95% sequence identity to the conserved domains of a native MOMP polypeptide (e.g., serovar E MOMP). In some embodiments, the conserved domain sequences of the modified MOMP polypeptide collectively have at least 90% or at least 95% sequence (e.g., at least 95%) identity to the conserved domains of a native MOMP polypeptide (e.g., the conserved domains as defined in Table 1).

Conserved domains of a modified MOMP polypeptide may comprise conserved domain sequences of MOMP from a serovar of *C. trachomatis* (e.g., serovars D-K, such as serovars D-G). In some embodiments, conserved domains of a modified MOMP polypeptide may comprise conserved domain sequences of MOMP from serovar E of *C. trachomatis*.

A modified MOMP polypeptide may comprise a non-native loop sequence between each of the conserved domain sequences. Thus, a modified MOMP polypeptide may comprise one, two, three or four non-native loop sequences. The one or more non-native loop sequence(s) may replace one, two, three or four of the corresponding native VD loops. Native VDs may be retained between any remaining conserved domains. The modified MOMP polypeptide may have five conserved domain sequences of a native *Chlamydia* sp. MOMP polypeptide. In some embodiments, the modified MOMP polypeptide does not comprise any native *Chlamydia* sp. MOMP VDs between any of the conserved domain sequences. In some embodiments, the modified MOMP polypeptide comprises four non-native loop sequences and does not comprise any native *Chlamydia* sp. MOMP VDs between the conserved domain sequences. In some embodiments, the modified MOMP polypeptide does not comprise any native *Chlamydia* sp. MOMP VDs (or fragments of at least 5, 6, or 7 consecutive amino acids thereof).

In some embodiments, the modified MOMP polypeptide comprises (1) all five conserved domain sequences of a *Chlamydia* sp. MOMP polypeptide of *C. trachomatis* of any serovar, and (2) four non-native loop sequences, wherein a non-native loop sequence is located between each of the conserved domain sequences, and wherein the modified MOMP polypeptide does not comprise any native *Chlamydia* sp. MOMP variable domains between any of the conserved domain sequences, further wherein the non-native loop sequences are between 3 and 30 amino acids in length and no more than 40% identical to any native *Chlamydia* sp. MOMP VD (VD1, VD2, VD3 or VD4) sequences of any serovar.

A modified MOMP polypeptide may comprise an amino acid sequence (e.g., from N terminus to C terminus) according to formula:

C1-L1-C2     (Formula I), wherein C1 and C2 are two conserved domain sequences of a native *Chlamydia* sp. MOMP polypeptide and L1 is a non-native loop sequence.

In some embodiments, the modified MOMP polypeptide comprises an amino acid sequence (e.g., from N terminus to C terminus) according to formula:

C1-L1-C2-L2-C3     (Formula II), wherein C1, C2 and C3 are three conserved domain sequences of a native *Chlamydia* sp. MOMP polypeptide and L1 and L2 are non-native loop sequences.

In some embodiments, a modified MOMP polypeptide comprises an amino acid sequence (e.g., from N terminus to C terminus) according to formula:

C1-L1-C2-L2-C3-L3-C4     (Formula III), wherein C1, C2, C3 and C4 are four conserved domain sequences of a native *Chlamydia* sp. MOMP polypeptide and L1, L2 and L3 are non-native loop sequences.

In some embodiments, a modified MOMP polypeptide comprises an amino acid sequence (e.g., from N terminus to C terminus) according to formula:

C1-L1-C2-L2-C3-L3-C4-L4-C5     (Formula IV)

wherein C1, C2, C3, C4 and C5 are five conserved domain sequences of a native *Chlamydia* sp. MOMP polypeptide and L1, L2, L3 and L4 are non-native loop sequences.

The conserved domain sequences and non-native loop sequences may be as described herein.

In some embodiments, C1-C5 correspond to the first, second, third, fourth and fifth conserved domains of a native *Chlamydia trachomatis* MOMP polypeptide, respectively (e.g., as defined in Table 1).

Accordingly, in some embodiments, a nucleic acid of the invention comprises a nucleotide sequence encoding a modified MOMP polypeptide which comprises or consists of the sequence set out in Formula I, II, III or IV, e.g., IV.

In some embodiments, the modified MOMP polypeptide comprises a sequence according to any one of SEQ ID NO: 486-489 (e.g., SEQ ID NO: 486) or a sequence that has at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identity thereto. In some embodiments, a modified MOMP polypeptide comprises a sequence having at least 90% identity to SEQ ID NO 486-489 (e.g., SEQ ID NO: 486). In some embodiments, a modified MOMP polypeptide comprises a sequence having at least 95% identity to SEQ ID NO 486-489 (e.g., SEQ ID NO: 486).

In some embodiments, the nucleic acid comprising a nucleotide sequence encoding a modified MOMP polypeptide comprises a nucleotide sequence according to any one of SEQ ID NO: 551-566 (e.g., SEQ ID NO: 551) or a sequence that has at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% (e.g., at least 75%) identity thereto. Typically, the nucleic acid comprises a nucleotide sequence according to SEQ ID NO: 551 or a sequence that has at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% (e.g., at least 75%) identity thereto. In some embodiments, the nucleic acid comprises a nucleotide sequence encoding a secretion signal peptide sequence as described herein, e.g., a secretion signal peptide sequence according to SEQ ID NO: 187.

In one embodiment, the nucleic acid of the invention is a mRNA comprising or consisting of (e.g., consisting of) the following structural elements:

(1) a 5' cap;

(2) a 5' untranslated region (5' UTR) having the nucleic acid sequence according to SEQ ID NO: 838;

(3) a protein coding region having the nucleic acid sequence according to SEQ ID NO: 213 optionally followed by a stop codon (e.g., TGA);

(4) a 3' untranslated region (3' UTR) having the nucleic acid sequence according to SEQ ID NO: 839; and (5) a polyA tail.

In one embodiment, the nucleic acid of the invention is a mRNA comprising or consisting of (e.g., consisting of) the following structural elements:

(1) a 5' cap with the following structure:

(2) a 5' untranslated region (5' UTR) having the nucleic acid sequence according to SEQ ID NO: 838;
(3) a protein coding region having the nucleic acid sequence according to SEQ ID NO: 213;
(4) a 3' untranslated region (3' UTR) having the nucleic acid sequence according to SEQ ID NO: 839; and
(5) a polyA tail.

In some embodiments, the 3' end of (1) bonds directly to the 5' end of (2) via a 3' to 5' phosphodiester linkage; the 3' end of (2) bonds directly to the 5' end of (3) via a 3' to 5' phosphodiester linkage; the 3' end of (3) bonds directly to the 5' end of (4) via a 3' to 5' phosphodiester linkage; and the 3' end of (4) bonds directly to the 5' end of (5) via a 3' to 5' phosphodiester linkage. In some embodiments, the mRNA is chemically modified and the chemical modification comprises N1-methylpseudouridine in place of every uridine. The mRNA may be encapsulated in a LNP.

Chimeric MOMP VD Polypeptides

The inventors have demonstrated that immunisation with chimeric *Chlamydia* sp. MOMP VD polypeptides comprising VD sequences of different *C. trachomatis* serovars elicited potent antibody responses. In particular, the inventors have shown that mRNAs encoding chimeric MOMP VD polypeptides which combined VD sequences of serovars that show lower levels of VD sequence identity with one another relative to other serovars successfully elicited potent antibody (IgG) responses. Chimeric MOMP VD polypeptides containing VD domains of which only one is from a particular serovar were able to elicit robust IgG responses against that serovar. IgG antibody response levels obtained using mRNAs encoding chimeric MOMP VD polypeptides were higher than those induced by immunisation with a mRNA encoding a polypeptide combining four VD4 sequences of serovars D, E, F and G (which was based on the polypeptide described in Anja W. Olsen, et al., Protection Against *Chlamydia trachomatis* Infection and Upper Genital Tract Pathological Changes by Vaccine-Promoted Neutralizing Antibodies Directed to the VD4 of the Major Outer Membrane Protein, The Journal of Infectious Diseases, Volume 212, Issue 6, 2015, Pages 978-989). Furthermore, IgG antibody response levels obtained using mRNAs encoding chimeric MOMP VD polypeptides were higher than those induced by immunisation with a mRNA encoding a native MOMP protein. The inventors have also demonstrated that immunisation with chimeric *Chlamydia* sp. MOMP VD polypeptides of the invention elicited a potent antibody (e.g., IgG) response against *C. trachomatis* elementary bodies (EBs). The elicited antibodies were cross-reactive against EBs of different serovars of *C. trachomatis*. The inventors have also demonstrated that a *Chlamydia* sp. MOMP VD polypeptide of the invention elicited a T cell response, including CD4+ and CD8+ T cells, such as IFNγ-producing CD4+ and CD8+ T cells. The inventors have demonstrated that the chimeric MOMP VD polypeptides of the invention are suitable vaccine candidates.

Thus, in another aspect, the invention provides a nucleic acid that comprises a nucleotide sequence encoding a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp. In a further aspect, the invention provides a chimeric *Chlamydia* sp. MOMP VD polypeptide, wherein the chimeric MOMP VD polypeptide comprises an amino acid sequence comprising two or more *Chlamydia* sp. MOMP VD sequences of different serovars of the *Chlamydia* sp. Native MOMP VD sequences are highly variable across *Chlamydia* sp. serovars and comprise epitopes that elicit a B cell (i.e., antibody) immune response. A chimeric MOMP VD polypeptide of the present invention may elicit a B cell (i.e., antibody) response, e.g., an antigen-specific antibody response, in a subject. The antibody response may be an IgG response. The elicited antibodies may bind *C. trachomatis* elementary bodies. The terms "chimeric MOMP VD construct", "chimeric *Chlamydia* sp. MOMP VD polypeptide" and "chimeric MOMP VD polypeptide" are used herein interchangeably.

Thus, a chimeric MOMP VD polypeptide of the invention comprising two or more MOMP VD sequences of different *Chlamydia* sp. serovars may elicit a B cell (i.e. antibody) response against more than one serovar of *C. trachomatis*, e.g., a cross-serovar response. Thus, the chimeric VD polypeptide of the present invention may elicit a B cell (antibody) response against two or more serovars of *Chlamydia* sp. The response may be a protective antibody response.

The inventors compared MOMP VD sequences of *C. trachomatis* and found different levels of sequence variation across serovars. MOMP VD sequences of some of the serovars were identical or had a high level of sequence identity (e.g., at least 70%) whereas for other serovars there was a greater degree of sequence variation. For example, VD1 sequences of serovars D and E have a high level of sequence identity and VD1 sequences of serovars F and G are identical. However, there is a much greater level of variation between VD1 sequences of (i) serovar D or E and (ii) serovar F or G. VD2 sequences of serovars D and E have a high level of sequence identity, and likewise VD2 sequences of serovars F and G have a high level of sequence identity. However, there is a much greater level of variation between VD2 sequences of (i) serovar D or E and (ii) serovar F or G. VD3 sequences of serovars D and F are identical, and VD3 sequences of serovars F and G have a high level of sequence identity. VD3 sequence of serovar E has a lower percentage of sequence identity compared to VD3 sequences of serovars D/F than compared to serovar G. However, the inventors have found that VD3 sequence of serovar E contains amino acid motifs that are homologous with sequences found in human proteome. For VD4, the sequences of serovars D and E have a high level of sequence identity, and likewise the sequences of serovars F and G have a high level of sequence identity. However, there is a much greater level of sequence variation between VD4 sequences of (i) serovar D or E and (ii) serovar F or G.

A chimeric MOMP VD polypeptide of the invention may therefore comprise two MOMP VD1 sequences of different serovars of a *Chlamydia* sp., wherein the two VD1 sequences have a lower sequence identity with one another than with VD1 sequences of other serovars of the *Chlamydia* sp. In some embodiments, the two MOMP VD1 sequences of different serovars of a *Chlamydia* sp. in the chimeric MOMP VD polypeptide are no more than 70%, 69%, 68%, 67%, 66%, 65%, 60%, 55%, 50%, 45%, 40%, 35%, 30%, 25% identical (e.g., no more than 50% identical) to each other. The serovars may be selected from *C. trachomatis* serovars D-K, e.g., D, E, F, and G.

A chimeric MOMP VD polypeptide of the invention may comprise two MOMP VD2 sequences of different serovars of a *Chlamydia* sp., wherein the two VD2 sequences have a lower sequence identity with one another than with VD2 sequences of other serovars of the *Chlamydia* sp. In some embodiments, the two MOMP VD2 sequences of different serovars of a *Chlamydia* sp. in the chimeric MOMP VD polypeptide are no more than 80%, 79%, 78%, 77%, 76%, 75%, 70%, 65%, 60%, 55%, 50%, 45%, 40%, 35%, 30%, 25% identical (e.g., no more than 50%) to each other. The serovars may be selected from *C. trachomatis* serovars D-K, e.g., D, E, F, and G.

A chimeric MOMP VD polypeptide of the invention may comprise two MOMP VD3 sequences of different serovars of a *Chlamydia* sp., wherein the two VD3 sequences have a lower sequence identity with one another than with VD3 sequences of other serovars of the *Chlamydia* sp. In some embodiments, the two MOMP VD3 sequences of different serovars of a *Chlamydia* sp. in the chimeric MOMP VD polypeptide are no more than 87%, 86%, 85%, 84%, 83%, 82%, 81%, 80%, 75%, 70%, 65%, 60%, 55%, 50%, 45%, 40%, 35%, 30%, 25% identical (e.g., no more than 70%) to each other. In other embodiments, the chimeric MOMP comprises a single MOMP VD3 domain. The serovars may be selected from *C. trachomatis* serovars D-K, e.g., D, E, F, and G.

A chimeric MOMP VD polypeptide of the invention may comprise two MOMP VD4 sequences of different serovars of a *Chlamydia* sp., wherein the two VD4 sequences have a lower sequence identity with one another than with VD4 sequences of other serovars of the *Chlamydia* sp. In some embodiments, the two MOMP VD4 sequences of different serovars of the *Chlamydia* sp. in a chimeric MOMP VD polypeptide may be no more than 77%, 76%, 75%, 74%, 73%, 72%, 71%, 70%, 65%, 60%, 55%, 50%, 45%, 40%, 35%, 30%, 25% identical (e.g., no more than 60% identical) to each other. The serovars may be selected from *C. trachomatis* serovars D-K, e.g., D, E, F, and G.

In exemplary embodiments, MOMP VD sequences in the chimeric MOMP VD polypeptide exclude sequence motifs that are found in a subject (e.g., human) proteome, e.g., sequence motifs of 8 or more, 9 or more, 10 or more, 11 or more, 12 or more, 13 or more, 14 or more or 15 or more (e.g., 8 or more) amino acids in length. Excluded subject proteome (e.g., human proteome) sequence motifs are typically 8 or more amino acids in length. As explained above, this helps minimise unwanted cross-reactivity.

In exemplary embodiments, the chimeric MOMP VD polypeptide comprises conserved domain sequence portions of a native *Chlamydia* sp. MOMP polypeptide flanking each of the two or more MOMP VD sequences.

The chimeric MOMP VD polypeptide may comprise 2, 3, 4, 5, 6, 7, 8, 9, 10, 11, 12, 13 or 14 MOMP VD sequences. In some embodiments, the chimeric MOMP VD polypeptide comprises seven MOMP VD sequences.

The *Chlamydia* sp. may be *C. trachomatis* and the serovars may be D-K.

The chimeric MOMP VD polypeptide may comprise MOMP VDs of two, three, four, five, six, seven or eight different serovars, e.g., serovars D-K of *C. trachomatis*. In some embodiments, the chimeric MOMP VD polypeptide comprises MOMP VDs of four different serovars, e.g., serovars D-G of *C. trachomatis*.

The chimeric MOMP VD polypeptide may comprise (i) two MOMP VD1 sequences of different serovars of the *Chlamydia* sp.; and/or (ii) two MOMP VD2 sequences of different serovars of the *Chlamydia* sp.; and/or (iii) one MOMP VD3 sequence; and/or (iv) two MOMP VD4 sequences of different serovars of the *Chlamydia* sp. In other embodiments, there are two MOMP VD3 sequences of different serovars of the *Chlamydia* sp. The different serovars may be selected from serovars D, E, F or G of *C. trachomatis*.

A chimeric MOMP VD polypeptide of the invention may therefore comprise one MOMP VD sequence of serovar D or E of *C. trachomatis* and one MOMP VD sequence of serovar F or G of *C. trachomatis*. In some embodiments, the chimeric MOMP VD polypeptide comprises a MOMP VD1 sequence of serovar D or E of *C. trachomatis* and a MOMP VD1 sequence of serovar F or G of *C. trachomatis* (for example, a MOMP VD1 sequence of serovar E of *C. trachomatis* and a MOMP VD1 sequence of serovar G of *C. trachomatis*). In some embodiments, the chimeric MOMP VD polypeptide comprises a MOMP VD2 sequence of serovar D or E of *C. trachomatis* and a MOMP VD2 sequence of serovar F or G of *C. trachomatis* (for example, a MOMP VD2 sequence of serovar D of *C. trachomatis* and a MOMP VD2 sequence of serovar G of *C. trachomatis*). In some embodiments, the chimeric MOMP VD polypeptide comprises a MOMP VD3 sequence of serovar D, F or G of *C. trachomatis* (for example, serovar F). In some embodiments, the chimeric MOMP VD polypeptide comprises a MOMP VD4 sequence of serovar D or E of *C. trachomatis* and a MOMP VD4 sequence of serovar F or G of *C. trachomatis* (for example, a MOMP VD4 sequence of serovar D of *C. trachomatis* and a MOMP VD4 sequence of serovar F of *C. trachomatis*).

A chimeric MOMP VD polypeptide of the invention may comprise two, three or four MOMP VD sequences of serovars D or E of *C. trachomatis* and two, three or four MOMP VD sequences of serovars F or G of *C. trachomatis*. In some embodiments, the chimeric MOMP VD polypeptide comprises one MOMP VD sequence of serovar D or E of *C. trachomatis* and one MOMP VD sequence of serovar F or G of *C. trachomatis* for each one of MOMP VD1, VD2, VD3, and VD4. In exemplary embodiments, the chimeric MOMP VD polypeptide comprises only one MOMP VD3 sequence, which corresponds to VD3 of serovar D, F or G of *C. Trachomatis* (e.g., serovar F).

A chimeric MOMP VD polypeptide may comprise at least one (e.g., one, two, three or four) of (i)-(iv): (i) a MOMP VD1 sequence from serovar D and a MOMP VD1 sequence from serovar F, or a MOMP VD1 sequence from serovar E and a MOMP VD1 sequence from serovar F; and/or (ii) a MOMP VD2 sequence from serovar E and a MOMP VD2 sequence from serovar F, or a MOMP VD2 sequence from serovar D and a MOMP VD2 sequence from serovar G; and/or (iii) a MOMP VD3 sequence from serovar G, or a MOMP VD3 sequence from serovar F; and/or (iv) a MOMP VD4 sequence from serovar E and a MOMP VD4 sequence from serovar G, or a MOMP VD4 sequence from serovar D and a MOMP VD4 sequence from serovar F, wherein the serovars D, E, F or G are of *C. trachomatis*. In some embodiments, the chimeric MOMP VD polypeptide comprises four of (i)-(iv). In some embodiments, the chimeric MOMP VD polypeptide comprises (i) a MOMP VD1 sequence from serovar E and a MOMP VD1 sequence from serovar G; and (ii) a MOMP VD2 sequence from serovar D and a MOMP VD2 sequence from serovar G; and (iii) a MOMP VD3 sequence from serovar F; and (iv) a MOMP VD4 sequence from serovar D and a MOMP VD4 sequence from serovar F, wherein the serovars D, E, F or G are of *C. trachomatis*. The MOMP VD1 sequence from serovar F of *C. trachomatis* is the same as the MOMP VD1 sequence from serovar G of *C. trachomatis*.

In some embodiments, the chimeric MOMP VD polypeptide comprises: (i) a MOMP VD1 sequence from serovar D and a MOMP VD1 sequence from serovar F, a MOMP VD2 sequence from serovar E and a MOMP VD2 sequence from serovar F, a MOMP VD3 sequence from serovar G, a MOMP VD4 sequence from serovar E and a MOMP VD4 sequence from serovar G; or (ii) a MOMP VD1 sequence from serovar E and a MOMP VD1 sequence from serovar F, a MOMP VD2 sequence from serovar D and a MOMP VD2 sequence from serovar G, a MOMP VD3 sequence from serovar F, a MOMP VD4 sequence from serovar D and a MOMP VD4 sequence from serovar F, wherein the serovars D, E, F or G are of *C. trachomatis*. In some embodiments, the chimeric MOMP VD polypeptide comprises MOMP VD sequences as in (i). Typically, the chimeric MOMP VD polypeptide comprises MOMP VD sequences as in (ii).

Typically, the chimeric MOMP VD polypeptide comprises a single amino acid substitution at one or more (e.g., all) positions corresponding to an N-glycosylation site in a native *Chlamydia* sp. MOMP polypeptide, e.g., in one or more MOMP VD domains.

A chimeric MOMP VD polypeptide as described herein may comprise conserved domain sequence portions that are portions of conserved domain sequences of a native *Chlamydia* sp. MOMP polypeptide flanking the VD in its native *Chlamydia* sp. MOMP polypeptide. The conserved domain sequences flanking the VD in its native *Chlamydia* sp. MOMP polypeptide may be immediately adjacent to the VD sequence.

Each conserved domain sequence portion in a chimeric MOMP VD polypeptide may comprise between 3 and 30 amino acid residues (e.g., between 4 and 20) of a conserved domain sequence of a native *Chlamydia* sp. MOMP polypeptide, wherein the between 3 and 30 (e.g., between 4 and 20) amino acid residues are immediately adjacent to the VD sequence in its native *Chlamydia* sp. MOMP polypeptide.

A chimeric MOMP VD polypeptide as described herein may comprise an amino acid sequence according to the following formula:

(Ax-VDx-Bx)y-(Aw-VDw-Bw)z, wherein

VDx comprises a VD sequence of VD1, VD2, VD3 or VD4 of a native *C. trachomatis* serovar y MOMP polypeptide;

Ax comprises between 3 and 30 (e.g., between 4 and 20) amino acid residues that immediately precede VDx in a native *Chlamydia* sp. MOMP polypeptide sequence of serovar y;

Bx comprises between 3 and 30 (e.g., between 4 and 20) amino acid residues that immediately follow VDx in a native *Chlamydia* sp. MOMP polypeptide sequence of serovar y;

VDw comprises a VD sequence of VD1, VD2, VD3 or VD4 of a native *C. trachomatis* serovar z MOMP polypeptide;

Aw comprises between 3 and 30 (e.g., between 4 and 20) amino acid residues that immediately precede VDw in a native *Chlamydia* sp. MOMP polypeptide sequence of serovar z;

Bw comprises between 3 and 30 (e.g., between 4 and 20) amino acid residues that immediately follow VDw in a native *Chlamydia* sp. MOMP polypeptide sequence of serovar z, x and w are independently selected from 1-4 and indicate the MOMP VD selected from VD1, VD2, VD3 or VD4; and y and z are serovars of *C. trachomatis* (e.g., selected from serovars D, E, F, or G).

In some embodiments, the chimeric MOMP VD polypeptide comprises a sequence according to any one of SEQ ID NO: 490-505 (e.g., SEQ ID NO: 495 or 503 (e.g., SEQ ID NO: 503)) or a sequence that has at least 70%, at least 75%, at least 76%, at least 77%, at least 78%, at least 79%, at least 80%, at least 81%, at least 82%, at least 83%, at least 84%, at least 85%, at least 90%, at least 91%, at least 92%, at least 93%, at least 94%, at least 95%, at least 96%, at least 97%, at least 98%, or at least 99% identity thereto. In some embodiments, the chimeric MOMP VD polypeptide comprises a sequence having at least 90% identity to SEQ ID NO 490-505 (e.g., SEQ ID NO: 495 or 503 (e.g., SEQ ID NO: 503). In some embodiments, the chimeric MOMP VD polypeptide comprises a sequence having at least 95% identity to any one of SEQ ID NO 490-505 (e.g., SEQ ID NO: 495 or 503 (e.g., SEQ ID NO: 503).

In some embodiments, a nucleic acid comprising a nucleotide sequence encoding the chimeric MOMP VD polypeptide comprises a nucleotide sequence according to any one of SEQ ID NO: 567-630 (e.g., SEQ ID NO: 617) or a sequence that has at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, a nucleic acid comprising a nucleotide sequence encoding the chimeric MOMP VD polypeptide comprises a nucleotide sequence that is least 85% identical to any one of SEQ ID NO: 567-630 (e.g., SEQ ID NO: 617).

In some embodiments, the nucleic acid comprises a nucleotide sequence encoding a secretion signal peptide sequence as described herein, e.g., a secretion signal peptide sequence according to SEQ ID NO: 187. For example, the nucleic acid may comprise a sequence according to SEQ ID NO: 870.

In one embodiment, the nucleic acid is a mRNA comprising or consisting of (e.g., consisting of) the following structural elements:
(1) a 5' cap;
(2) a 5' untranslated region (5' UTR) having the nucleic acid sequence according to SEQ ID NO: 838;
(3) a protein coding region having the nucleic acid sequence according to SEQ ID NO: 870 optionally followed by a stop codon (e.g., TGA);
(4) a 3' untranslated region (3' UTR) having the nucleic acid sequence according to SEQ ID NO: 839; and
(5) a polyA tail.

In one embodiment, the nucleic acid is a mRNA comprising or consisting of (e.g., consisting of) the following structural elements:
(1) a 5' cap with the following structure:

*C. trachomatis*. In some embodiments, the chimeric MOMP VD polypeptide comprises all four VD4 domains (i)-(iv). In some embodiments, the chimeric MOMP VD polypeptide comprises a sequence according to any one of SEQ ID NOs: 506, 841, 842 or 843 or a sequence with at least 90% or at least 95% identity thereto.

*Chlamydia* sp. Antigens Other than MOMP

The inventors have identified *Chlamydia* sp. antigens other than MOMP ("non-MOMP antigens") which may be used in the present invention. Non-MOMP antigens or the nucleic acids encoding them may be provided or used in combination with MOMP antigens, including the MOMP antigens (and the nucleic acids encoding them) described herein. These non-MOMP antigens include *Chlamydia* sp. polypeptides CT443, CT584, CT600 and CT812. These antigens are highly abundant outer membrane proteins and are highly conserved across *Chlamydia* sp., e.g., across serovars of *C. trachomatis*. The use of any one or more of these antigens may therefore provide a cross-serovar immune response, i.e., an immune response that is cross-reactive against two or more serovars of *Chlamydia* sp. (e.g., (2) a 5' untranslated region (5' UTR) having the nucleic acid sequence according to SEQ ID NO: 838;
(3) a protein coding region having the nucleic acid sequence according to SEQ ID NO: 870;
(4) a 3' untranslated region (3' UTR) having the nucleic acid sequence according to SEQ ID NO: 839; and
(5) a polyA tail.

In some embodiments, the 3' end of (1) bonds directly to the 5' end of (2) via a 3' to 5' phosphodiester linkage; the 3' end of (2) bonds directly to the 5' end of (3) via a 3' to 5' phosphodiester linkage; the 3' end of (3) bonds directly to the 5' end of (4) via a 3' to 5' phosphodiester linkage; and the 3' end of (4) bonds directly to the 5' end of (5) via a 3' to 5' phosphodiester linkage. In some embodiments, the mRNA is chemically modified and the chemical modification comprises N1-methylpseudouridine in place of every uridine. The mRNA may be encapsulated in a LNP.

In alternative embodiments, a chimeric MOMP VD polypeptide comprises three MOMP VD4 sequences selected from (i) a MOMP VD4 sequence of serovar D of *C. trachomatis*; (ii) a MOMP VD4 sequence of serovar E of *C. trachomatis*; (iii) a MOMP VD4 sequence of serovar F of *C. trachomatis*; or (iv) a MOMP VD4 sequence of serovar G of cross-reactive against two or more serovars of *C. trachomatis*). The inventors have demonstrated that *C. trachomatis* polypeptides CT443, CT584, CT600 and CT812 elicited a T cell response when delivered either as mRNAs expressing the relevant antigen or in the form of recombinant proteins. The inventors have also shown that at least mRNAs encoding *C. trachomatis* polypeptides CT443, CT584 or CT600 as well as recombinant CT443, CT584 or CT600 proteins induced robust antigen-specific antibody responses.

CT443 The inventors have demonstrated that both mRNA encoding *C. trachomatis* CT443 polypeptide and a recombinant *C. trachomatis* CT443 protein elicited IFNγ-producing T cells. Furthermore, *C. trachomatis* CT443 polypeptide elicited a robust IgG response when delivered either as a mRNA expressing the antigen or in the form of a recombinant protein. *C. trachomatis* CT443 polypeptide delivered as a mRNA was shown to elicit a potent antibody (e.g., IgG) response against *C. trachomatis* elementary bodies (EBs). The elicited antibodies were cross-reactive against EBs of different serovars of *C. trachomatis*. The inventors have demonstrated that the *C. trachomatis* CT443 polypeptides of the invention are suitable vaccine candidates.

In one aspect, the invention provides a nucleic acid that comprises a nucleotide sequence encoding a *Chlamydia* sp. CT443 polypeptide. In another aspect, the invention provides a polypeptide comprising amino acid sequence of a *Chlamydia* sp. CT443 polypeptide. A *Chlamydia* sp. CT443 polypeptide for use in the present invention may elicit an antibody (e.g., IgG) response (e.g., an antigen-specific antibody response) in a subject. The elicited antibodies may bind *C. trachomatis* elementary bodies. The *Chlamydia* sp. CT443 polypeptide of the invention may elicit an antibody (IgG) response against more than one serovar of *C. trachomatis*, e.g., a cross-serovar response. Thus, the *Chlamydia* sp. CT443 polypeptide of the present invention may elicit a B cell (antibody) response against two or more serovars of *Chlamydia* sp. The response may be a protective antibody response.

A *Chlamydia* sp. CT443 polypeptide for use in the present invention may elicit a T cell response (e.g., antigen-specific T cell response) in a subject. In some embodiments, a *Chlamydia* sp. CT443 polypeptide for use in the present invention elicits IFNγ-producing T cells such as IFNγ-producing CD4+ T cells and/or IFNγ-producing CD8+ T cells in a subject.

CT443 (also referred to as outer membrane protein B (omcB or OMPB)) is an abundant outer membrane protein. It has been suggested that CT443 is an adhesin which promotes the interaction between the *C. trachomatis* elementary body and the host cell.[24] CT443, and in particular, its C-terminus, was shown to be immunogenic during human infection.[25,26] It was also reported to be a protective antigen in mouse models.[27,28]

A "*Chlamydia* sp. CT443 polypeptide" includes a mature form of a full-length native CT443 polypeptide of a *Chlamydia* sp. without its native signal peptide sequence and immunogenic variants thereof. An immunogenic variant of a native *Chlamydia* sp. CT443 polypeptide is capable of eliciting an immune response (e.g., an antigen specific immune response) in a subject, for example a T cell response and/or an antibody response. Immunogenic variants of a native *Chlamydia* sp. CT443 polypeptide include immunogenic fragments of a native *Chlamydia* sp. CT443 polypeptide. Immunogenic CT443 fragments include fragments of a native *Chlamydia* sp. CT443 polypeptide that are at least 50, at least 75, at least 100, at least 125, at least 150, at least 175, at least 200, at least 225, at least 250, at least 275, at least 300, at least 325, at least 350, at least 375, at least 400, at least 425, at least 450, at least 475 or at least 500 amino acids long. Typically, the CT443 polypeptide of the invention is a full-length *Chlamydia* sp. CT443 polypeptide. In some embodiments, immunogenic variants exclude sequence motifs that are found in a subject (e.g., human) proteome, e.g., sequence motifs of 8 or more, 9 or more, 10 or more, 11 or more, 12 or more, 13 or more, 14 or more or 15 or more (e.g., 8 or more) amino acids in length. Excluded subject proteome sequence motifs are typically 8 or more amino acids in length. As explained above, this helps minimise unwanted cross-reactivity.

Exemplary *Chlamydia* sp. CT443 polypeptide sequences include a *Chlamydia trachomatis* CT443 polypeptide sequence (see SEQ ID NO: 507 which lacks native signal peptide sequence of the *Chlamydia trachomatis* CT443 polypeptide).

In some embodiments, the *Chlamydia* sp. CT443 polypeptide comprises the sequence of any one of SEQ ID NO: 507-508 (e.g., SEQ ID NO: 507) or a sequence having at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identity thereto. In some embodiments, the *Chlamydia* sp. CT443 polypeptide comprises a sequence having at least 90% identity to any one of SEQ ID NO 507-508 (e.g., SEQ ID NO: 507). In some embodiments, the *Chlamydia* sp. CT443 polypeptide comprises a sequence having at least 95% identity to any one of SEQ ID NO 507-508 (e.g., SEQ ID NO: 507).

In some embodiments, a nucleic acid comprising a nucleotide sequence encoding a *Chlamydia* sp. CT443 polypeptide comprises a nucleotide sequence according to any one of SEQ ID NO: 707-710 (e.g., SEQ ID NO: 707) or a sequence that has at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the nucleic acid comprises a nucleotide sequence that is least 85% identical to any one of SEQ ID NO: 707-710 (e.g., SEQ ID NO: 707). In some embodiments, the nucleic acid comprises a nucleotide sequence encoding a secretion signal peptide sequence as described herein, e.g., a secretion signal peptide sequence according to SEQ ID NO: 187. For example, the nucleic acid may comprise a sequence according to SEQ ID NO: 369.

In one embodiment, the nucleic acid is a mRNA comprising or consisting of (e.g., consisting of) the following structural elements:

(1) a 5' cap:

(2) a 5' untranslated region (5' UTR) having the nucleic acid sequence according to SEQ ID NO: 838; (3) a protein coding region having the nucleic acid sequence according to SEQ ID NO: 369 optionally followed by a stop codon (e.g., TGA);

(4) a 3' untranslated region (3' UTR) having the nucleic acid sequence according to SEQ ID NO: 839; and (5) a polyA tail.

In one embodiment, the nucleic acid is a mRNA comprising or consisting of (e.g., consisting of) the following structural elements:

(1) a 5' cap with the following structure:

(2) a 5' untranslated region (5' UTR) having the nucleic acid sequence according to SEQ ID NO: 838;
(3) a protein coding region having the nucleic acid sequence according to SEQ ID NO: 369;
(4) a 3' untranslated region (3' UTR) having the nucleic acid sequence according to SEQ ID NO: 839; and
(5) a polyA tail.

In some embodiments, the 3' end of (1) bonds directly to the 5' end of (2) via a 3' to 5' phosphodiester linkage; the 3' end of (2) bonds directly to the 5' end of (3) via a 3' to 5' phosphodiester linkage; the 3' end of (3) bonds directly to the 5' end of (4) via a 3' to 5' phosphodiester linkage; and the 3' end of (4) bonds directly to the 5' end of (5) via a 3' to 5' phosphodiester linkage. In some embodiments, the mRNA is chemically modified and the chemical modification comprises N1-methylpseudouridine in place of every uridine. The mRNA may be encapsulated in a LNP.

CT584

The inventors have demonstrated that mRNAs encoding C. trachomatis CT584 polypeptide and a recombinant C. trachomatis CT584 protein elicited IFNγ-producing T cells. Furthermore, C. trachomatis CT584 polypeptide was shown to elicit a robust IgG response when delivered either as a mRNA expressing the antigen or in the form of a recombinant protein. C. trachomatis CT584 polypeptide delivered as a mRNA was shown to elicit a potent antibody (e.g., IgG) response against C. trachomatis elementary bodies (EBs). The elicited antibodies were cross-reactive against EBs of different serovars of C. trachomatis. The inventors have demonstrated that the C. trachomatis CT584 polypeptides of the invention are suitable vaccine candidates.

In one aspect, the invention provides a nucleic acid that comprises a nucleotide sequence encoding a Chlamydia sp. CT584 polypeptide. In another aspect, the invention provides a polypeptide comprising amino acid sequence of a Chlamydia sp. CT584 polypeptide. A Chlamydia sp. CT584 polypeptide for use in the present invention may elicit an antibody (e.g., IgG) response (e.g., an antigen-specific antibody response) in a subject. The elicited antibodies may bind C. trachomatis elementary bodies. The Chlamydia sp. CT584 polypeptide of the invention may elicit an antibody (IgG) response against more than one serovar of C. trachomatis, e.g., a cross-serovar response. Thus, the Chlamydia sp. CT584 polypeptide of the present invention may elicit a B cell (antibody) response against two or more serovars of Chlamydia sp. The response may be a protective antibody response.

A Chlamydia sp. CT584 polypeptide for use in the present invention may elicit a T cell response (e.g., antigen-specific T cell response) in a subject. In some embodiments, a Chlamydia sp. CT584 polypeptide for use in the invention elicits IFNγ-producing T cells such as IFNγ-producing CD4+ T cells and/or IFNγ-producing CD8+ T cells in a subject.

CT584 is a putative tip protein in a Type III secretion system (based on computational structure prediction and homology search study on C. trachomatis).[29] It has high sequence homology with proteins from other Chlamydiae, but it does not share homology with proteins from other bacterial genera.[30] It is also universally conserved amongst all C. trachomatis serovars. CT584 is therefore a promising target antigen for generating cross-serovar immune responses.

A "Chlamydia sp. CT584 polypeptide" includes a full-length native CT584 polypeptide of a Chlamydia sp. and immunogenic variants thereof. An immunogenic variant of a Chlamydia sp. CT584 polypeptide is capable of eliciting an immune response in a subject, for example a T cell response and/or an antibody response (e.g., an antigen-specific T cell and/or antibody responses). Immunogenic variants of CT584 include immunogenic fragments of a native Chlamydia sp. CT584 polypeptide. Immunogenic CT584 fragments include fragments of a native Chlamydia sp. CT584 polypeptide that are at least 50, at least 75, at least 100, at least 125, at least 150, at least 175 amino acids long. Typically, the CT584 polypeptide of the invention is a full-length Chlamydia sp. CT584 polypeptide. In embodiments, immunogenic variants exclude sequence motifs that are found in a subject (e.g., human) proteome, e.g., sequence motifs of 8 or more, 9 or more, 10 or more, 11 or more, 12 or more, 13 or more, 14 or more or 15 or more amino acids in length. Excluded subject proteome (e.g., human proteome) sequence motifs are typically 8 or more amino acids in length. As explained above, this helps minimise unwanted cross-reactivity.

Exemplary Chlamydia sp. CT584 polypeptide sequences include a Chlamydia trachomatis CT584 polypeptide sequence (see SEQ ID NO: 509). Typically, the *Chlamydia* sp. CT584 polypeptide of the invention comprises a single amino acid substitution at a position corresponding to residue 11 of SEQ ID NO: 509 (e.g., a N to Q substitution).

In some embodiments, the *Chlamydia* sp. CT584 polypeptide comprises the sequence of any one of SEQ ID NO: 509-512 (SEQ ID NO: 510) or a sequence having at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the *Chlamydia* sp. CT584 polypeptide comprises a sequence having at least 90% identity to any one of SEQ ID NO 509-512 (e.g., SEQ ID NO: 510). In some embodiments, the *Chlamydia* sp. CT584 polypeptide comprises a sequence having at least 95% identity to any one of SEQ ID NO 509-512 (e.g., SEQ ID NO: 510).

In some embodiments, a nucleic acid comprising a nucleotide sequence encoding a *Chlamydia* sp. CT584 polypeptide comprises a nucleotide sequence according to any one of SEQ ID NO: 711-718 (e.g., SEQ ID NO: 715) or a sequence that has at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the nucleic acid comprises a nucleotide sequence that is least 85% identical to any one of SEQ ID NO: 711-718 (e.g., SEQ ID NO: 715). In some embodiments, the nucleic acid comprises a nucleotide sequence encoding a secretion signal peptide sequence as described herein, e.g., a secretion signal peptide sequence according to SEQ ID NO: 187. For example, the nucleic acid may comprise a sequence according to SEQ ID NO: 377.

In one embodiment, the nucleic acid is a mRNA comprising or consisting of (e.g., consisting of) the following structural elements:

(1) a 5' cap:
(2) a 5' untranslated region (5' UTR) having the nucleic acid sequence according to SEQ ID NO: 838;
(3) a protein coding region having the nucleic acid sequence according to SEQ ID NO: 377 optionally followed by a stop codon (e.g., TGA);
(4) a 3' untranslated region (3' UTR) having the nucleic acid sequence according to SEQ ID NO: 839; and
(5) a polyA tail.

In one embodiment, the nucleic acid is a mRNA comprising or consisting of (e.g., consisting of) the following structural elements:

(1) a 5' cap with the following structure:

(2) a 5' untranslated region (5' UTR) having the nucleic acid sequence according to SEQ ID NO: 838;
(3) a protein coding region having the nucleic acid sequence according to SEQ ID NO: 377;
(4) a 3' untranslated region (3' UTR) having the nucleic acid sequence according to SEQ ID NO: 839; and
(5) a polyA tail.

In some embodiments, the 3' end of (1) bonds directly to the 5' end of (2) via a 3' to 5' phosphodiester linkage; the 3' end of (2) bonds directly to the 5' end of (3) via a 3' to 5' phosphodiester linkage; the 3' end of (3) bonds directly to the 5' end of (4) via a 3' to 5' phosphodiester linkage; and the 3' end of (4) bonds directly to the 5' end of (5) via a 3' to 5' phosphodiester linkage. In some embodiments, the mRNA is chemically modified and the chemical modification comprises N1-methylpseudouridine in place of every uridine. The mRNA may be encapsulated in a LNP.

CT600

The inventors have demonstrated that *C. trachomatis* polypeptide CT600 elicited a robust IgG response when delivered either as a mRNA expressing the antigen or in the form of a recombinant protein. The inventors have also shown that a mRNA encoding *C. trachomatis* CT600 polypeptide and a recombinant *C. trachomatis* CT600 protein were able to elicit IFNγ-producing T cells.

In one aspect, the invention provides a nucleic acid that comprises a nucleotide sequence encoding a *Chlamydia* sp. CT600 polypeptide. In another aspect, the invention provides a polypeptide comprising amino acid sequence of a *Chlamydia* sp. CT600 polypeptide. A *Chlamydia* sp. CT600 polypeptide for use in the present invention may elicit an antibody (e.g., IgG) response (e.g., an antigen-specific antibody response) in a subject. *C. trachomatis* CT600 polypeptide delivered as a mRNA was shown to elicit a potent antibody (e.g., IgG) response against *C. trachomatis* elementary bodies (EBs). The elicited antibodies were cross-reactive against EBs of different serovars of *C. trachomatis*. The inventors have demonstrated that the *C. trachomatis* C600 polypeptides of the invention are suitable vaccine candidates.

A *Chlamydia* sp. CT600 polypeptide for use in the present invention may elicit a T cell response (e.g., antigen-specific T cell response) in a subject. In some embodiments, a *Chlamydia* sp. CT600 polypeptide for use in the invention elicits IFNγ-producing T cells such as IFNγ-producing CD4+ T cells and/or IFNγ-producing CD8+ T cells in a subject.

CT600 is a *Chlamydia* sp. Peptidoglycan-Associated Lipoprotein (Pal), which is thought to form a cross-bridge between the peptidoglycan and outer membrane.

A "*Chlamydia* sp. CT600 polypeptide" includes a mature form of a full-length native CT600 polypeptide of a *Chlamydia* sp. without its native signal peptide sequence. An immunogenic variant of a native *Chlamydia* sp. CT600 polypeptide is capable of eliciting an immune response (e.g., an antigen specific immune response) in a subject, for example a T cell response and/or an antibody response. Immunogenic variants of a native *Chlamydia* sp. CT600 polypeptide include immunogenic fragments of a native *Chlamydia* sp. CT600 polypeptide. Immunogenic CT600 fragments include fragments of a native *Chlamydia* sp. CT600 polypeptide that are at least 50, at least 75, at least 100, at least 125 or at least 150 amino acids long. Exemplary immunogenic fragments of a *Chlamydia* sp. CT600 polypeptide include fragments lacking the N-terminal cysteine-rich region of a *Chlamydia* sp. CT600 polypeptide (e.g., fragments lacking 13 amino acids that immediately follow the native signal peptide of a *Chlamydia* sp. CT600 polypeptide). In embodiments, immunogenic fragments exclude sequence motifs that are found in a subject (e.g., human) proteome, e.g., sequence motifs of 8 or more, 9 or more, 10 or more, 11 or more, 12 or more, 13 or more, 14 or more or 15 or more amino acids in length. Excluded subject proteome (e.g., human proteome) sequence motifs are typically 8 or more amino acids in length. As explained above, this helps minimise unwanted cross-reactivity.

Exemplary *Chlamydia* sp. CT600 polypeptide sequences include a *Chlamydia trachomatis* CT600 polypeptide sequence in SEQ ID NO: 513 which lacks a native signal peptide sequence of the *Chlamydia trachomatis* CT600 polypeptide and the 13 amino acid-long region which immediately follows the signal peptide.

In some embodiments, the *Chlamydia* sp. CT600 polypeptide comprises the sequence of SEQ ID NO: 513 or 514 or a sequence having at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the *Chlamydia* sp. CT600 polypeptide comprises a sequence having at least 90% identity to any one of SEQ ID NO 513-514. In some embodiments, the *Chlamydia* sp. CT600 polypeptide comprises a sequence having at least 95% identity to any one of SEQ ID NO 513-514.

In some embodiments, a nucleic acid comprising a nucleotide sequence encoding a *Chlamydia* sp. CT600 polypeptide comprises a nucleotide sequence according to any one of SEQ ID NO: 719-722 or a sequence that has at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the nucleic acid comprises a nucleotide sequence that is least 85% identical to any one of SEQ ID NO: 719-722.

CT812

The inventors have demonstrated that mRNAs encoding *C. trachomatis* CT812 polypeptide and a recombinant *C. trachomatis* CT812 protein induced IFNγ-producing T cells.

In one aspect, the invention provides a nucleic acid that comprises a nucleotide sequence encoding a *Chlamydia* sp. CT812 polypeptide. In another aspect, the invention provides a polypeptide comprising amino acid sequence of a *Chlamydia* sp. CT812 polypeptide. A *Chlamydia* sp. CT812 polypeptide for use in the present invention may elicit an antibody (e.g., IgG) response (e.g., an antigen-specific antibody response) in a subject. A *Chlamydia* sp. CT812 polypeptide for use in the present invention may elicit a T cell response (e.g., antigen-specific T cell response) in a subject. In some embodiments, a *Chlamydia* sp. CT812 polypeptide for use in the invention elicits IFNγ-producing T cells such as IFNγ-producing CD4+ T cells and/or IFNγ-producing CD8+ T cells in a subject.

CT812 (also referred to as Polymorphic Membrane Protein D (or PmpD)) is an autotransporter protein anchored in the outer membrane of *Chlamydia* sp. bacteria. CT812 is a proposed adhesin protein. Mature CT812 comprises a passenger domain and a beta barrel domain.[32]. Immunisation with recombinant CT812 protein has been shown to be protective against *C. trachomatis* serovar D in mice.[31]

A "*Chlamydia* sp. CT812 polypeptide" as used herein includes a mature form of a full-length native CT812 polypeptide of a *Chlamydia* sp. without its native signal peptide sequence and immunogenic variants thereof. An immunogenic variant of a *Chlamydia* sp. CT812 polypeptide is capable of eliciting an immune response (e.g., an antigen specific immune response) in a subject, for example a T cell response and/or an antibody response. Immunogenic variants of a native *Chlamydia* sp. CT812 polypeptide include immunogenic fragments of a native *Chlamydia* sp. CT812 polypeptide. Immunogenic CT812 fragments include fragments of a native *Chlamydia* sp. CT812 polypeptide that are at least 50, at least 75, at least 100, at least 150, at least 200, at least 250, at least 300, at least 350, at least 400, at least 450, at least 500, at least 550, at least 600, at least 650, at least 700, at least 750, at least 800, at least 850, at least 900, at least 950, at least 1000, at least 1050, at least 1100 or at least 1150 amino acids long. In some embodiments, immunogenic fragments of a *Chlamydia* sp. CT812 polypeptide include fragments of the amino acid sequence in SEQ ID NO: 515. In some embodiments, immunogenic fragments may be fragments of the passenger domain, e.g., fragments comprising residues 52-1003 of SEQ ID NO: 515 or residues 52-1179 of SEQ ID NO: 515. In some embodiments, immunogenic fragments comprise the amino acid sequence according to SEQ ID NOs: 516 or 518. In some embodiments, fragments of the passenger domain may be at least 600, at least 650, at least 700, at least 750, at least 800, at least 850, at least 900, at least 950, at least 1000, at least 1050, at least 1100 or at least 1150 amino acids long. In some embodiments, immunogenic fragments exclude sequence motifs that are found in a subject (e.g., human) proteome, e.g., sequence motifs of 8 or more, 9 or more, 10 or more, 11 or more, 12 or more, 13 or more, 14 or more or 15 or more amino acids in length. Excluded subject proteome (e.g., human proteome) sequence motifs are typically 8 or more amino acids in length. As explained above, this helps minimise unwanted cross-reactivity.

Exemplary *Chlamydia* sp. CT812 polypeptide sequences include a *Chlamydia trachomatis* CT812 polypeptide sequence in SEQ ID NO: 515 which lacks a native signal peptide sequence of the *Chlamydia trachomatis* CT812 polypeptide. *Chlamydia* sp. CT812 polypeptide sequences also include SEQ ID NOs 516 and 518.

In some embodiments, the *Chlamydia* sp. CT812 polypeptide comprises the sequence of any one of SEQ ID NO: 515-535 or a sequence having at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the *Chlamydia* sp. CT812 polypeptide comprises a sequence having at least 90% identity to any one of SEQ ID NO 515-535. In some embodiments, the *Chlamydia* sp. CT812 polypeptide comprises a sequence having at least 95% identity to any one of SEQ ID NO 515-535.

In some embodiments, a nucleic acid comprising a nucleotide sequence encoding a *Chlamydia* sp. CT812 polypeptide comprises a nucleotide sequence according to any one of SEQ ID NO: 723-762 or a sequence that has at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity thereto. In some embodiments, the nucleic acid comprises a nucleotide sequence that is least 85% identical to any one of SEQ ID NO: 723-762.

Variants of Modified MOMP Polypeptides, Chimeric MOMP VD Polypeptides and Non-MOMP Antigen Polypeptides The sequences of the modified MOMP polypeptide, the chimeric *Chlamydia* sp. MOMP VD polypeptides, *Chlamydia* sp. CT443 polypeptides, *Chlamydia* sp. CT584 polypeptides, *Chlamydia* sp. CT600 polypeptides and/or *Chlamydia* sp. CT812 polypeptides as described herein may comprise one or more mutations or modifications.

In some embodiments, the modified MOMP polypeptides, the chimeric *Chlamydia* sp. MOMP VD polypeptides, *Chlamydia* sp. CT443 polypeptides, *Chlamydia* sp. CT584 polypeptides, *Chlamydia* sp. CT600 polypeptides and/or *Chlamydia* sp. CT812 polypeptides as described herein may comprise one or more conservative amino acid substitutions.

A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In some embodiments, a string of amino acids can be conservatively replaced with a structurally similar string that differs in order and/or composition of side chain family members.

Mutation of Cysteine Residues

One or more cysteine residues in the polypeptides described herein may be mutated by single amino acid substitutions, e.g., to a serine residue. Cysteine residues are involved in disulphide bridge formation and thus cysteine mutations may limit polypeptide multimerisation.

In some embodiments, a modified MOMP polypeptide described herein comprises a single amino acid substitution at one or more (e.g., all) positions corresponding to a cysteine residue in a conserved domain sequence of a native *Chlamydia* sp. MOMP polypeptide. In some embodiments, a chimeric MOMP VD polypeptide described herein may comprise a single amino acid substitution at one or more (e.g., all) positions corresponding to a cysteine residue in a conserved domain sequence of a native *Chlamydia* sp. MOMP polypeptide. Conserved domains of a native *C. trachomatis* serovar E MOMP polypeptides comprise Cys residues at positions C48, C51, C55, C124, C137, C204, C206, C229 and/or C357 of SEQ ID NO: 2. Conserved domains of native MOMP polypeptides of *Chlamydia* sp. may comprise cysteine residues at positions corresponding to the residues set out for the native MOMP polypeptide of serovar E of *C. trachomatis*.

In some embodiments, the *Chlamydia* sp. CT443 polypeptide described herein comprises a single amino acid substitution at one or more (e.g., all) positions corresponding to a cysteine residue in a native *Chlamydia* sp. CT443 polypeptide. In some embodiments, the *Chlamydia* sp. CT443 polypeptide comprises one or more single amino acid substitutions at positions corresponding to C57, C100, C111, C156, C157, C164, C166, C175, C181, C191, C194, C252, C268, C285, C299, C341, C380, C383, C386, C389, C405, C410, C414 and/or C424 of SEQ ID NO: 507. In some embodiments, the *Chlamydia* sp. CT443 polypeptide comprises one or more single amino acid substitutions at positions corresponding to C57, C100, C111, C156, C157, C164, C166, C175, C181, C191, C194, C252, C268, C285, C299, C341, C380, C386, C405, C410, C414 and/or C424 of SEQ ID NO: 507. Typically, however, the *Chlamydia* sp.

CT443 polypeptide described herein does not comprise a single amino acid substitution at any positions corresponding to a cysteine residue in a native *Chlamydia* sp. CT443 polypeptide.

In some embodiments, the *Chlamydia* sp. CT584 polypeptide described herein comprises a single amino acid substitution at one or more (e.g., all) positions corresponding to a cysteine residue in a native *Chlamydia* sp. CT584 polypeptide. In some embodiments, the *Chlamydia* sp. CT584 polypeptide comprises one or more single amino acid substitutions at positions corresponding to C44, C114 and/or C138 of SEQ ID NO: 509.

In some embodiments, the *Chlamydia* sp. CT600 polypeptide described herein comprises a single amino acid substitution at one or more (e.g., all) positions corresponding to a cysteine residue in a native *Chlamydia* sp. CT600 polypeptide. In some embodiments, the *Chlamydia* sp. CT600 polypeptide comprises one or more (e.g., all) single amino acid substitutions at positions corresponding to C1, C5, C10, and/or C13 of SEQ ID NO: 844.

In some embodiments, the *Chlamydia* sp. CT812 polypeptide described herein comprises a single amino acid substitution at one or more (e.g., all) positions corresponding to a cysteine residue in a native *Chlamydia* sp. CT812 polypeptide. In some embodiments, the *Chlamydia* sp. CT812 polypeptide comprises one or more (e.g., all) single amino acid substitutions at positions corresponding to C1, C96, C160, C169, C179, C187, C233, C291, C300, C331, C348, C365, C401, C432, C560, C570, C571, C641, C665, C756, C838, C859, C963, C980 and/or C1477 of SEQ ID NO: 515. In some embodiments, the *Chlamydia* sp. CT812 polypeptide comprises one or more (e.g., all) single amino acid substitutions at positions corresponding to C96, C169, C291, C300, C331, C348, C365, C401, C432, C560, C570, C571, C756, C838, C859, C963 and/or C980 of SEQ ID NO: 515.

Mutation of Glycosylation Sites

Glycosylation may occur in eukaryotic cells but not in prokaryotic cells. "Glycosylation" as used herein refers to the addition of a saccharide unit to a protein. In particular, N-linked glycosylation is the attachment of glycan to an amide nitrogen of an asparagine (Asn; N) residue of a protein. Glycosylation can occur at any asparagine residue in a protein that is accessible to and recognised by glycosylating enzymes following translation of the protein, and is most common at accessible asparagines that are part of an NXS/T motif, wherein the second amino acid residue following the asparagine is a serine (Ser; S) or threonine (Thr; T). O-linked glycosylation is the attachment of a glycan to the oxygen atom of serine (Ser) or threonine (Thr) residue in a protein. The process of attachment results in a glycosylated protein. This glycan may be a polysaccharide. A non-human glycosylation pattern can render a polypeptide undesirably reactogenic when used to elicit antibodies. Additionally, glycosylation of a polypeptide that is not normally glycosylated (such as polypeptides described herein) may alter its immunogenicity. For example, glycosylation can mask important immunogenic epitopes within a protein. Thus, to reduce or eliminate glycosylation, either asparagine residues or serine/threonine residues can be modified, for example, by substitution to another amino acid.

In certain embodiments, one or more of the modified MOMP polypeptide, chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein comprises at least one mutated glycosylation site, e.g., at least one mutated N-linked glycosylation site and/or at least one O-linked glycosylation site. In some embodiments, one or more N-glycosylation sites in one or more of the modified MOMP polypeptide, chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein are removed. The removal of an N-glycosylation site may decrease glycosylation of the polypeptide. The removal of a glycosylation site may decrease glycosylation of the polypeptide. In some embodiments, one or more of the modified MOMP polypeptide, the chimeric *Chlamydia* sp. MOMP VD polypeptides, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein has decreased glycosylation relative to the respective native polypeptide. The removal of N-glycosylation sites may eliminate N-glycosylation of the polypeptide. The removal of O-glycosylation sites may eliminate O-glycosylation of the polypeptide.

In certain embodiments, the modification comprises a substitution of one or more of an N, S, and T amino acid in an NXS/T sequence motif, wherein X corresponds to any amino acid. In some embodiments, the modification comprises a substitution of one or more serine (Ser) or threonine (Thr) residue(s) in a protein.

In some embodiments, an N, S, or T amino acid is substituted with a conservative amino acid substitution. Typically, an N amino acid may be substituted with a Q, S, K or A amino acid.

In some embodiments, the chimeric MOMP VD polypeptide described herein comprises a single amino acid substitution at one or more (e.g., all) positions corresponding to an N-glycosylation site in a native *Chlamydia* sp. MOMP polypeptide. N-glycosylation sites in a native *Chlamydia* sp. MOMP polypeptide may be in one or more MOMP VD domains. N-glycosylation sites may be present in MOMP VD1 of serovar E (position 9 of SEQ ID NO: 9), MOMP VD1 of serovar F (position 11 of SEQ ID NO: 13), MOMP VD1 of serovar G (position 11 of SEQ ID NO: 17), MOMP VD2 of serovar E (position 6 and/or 17 of SEQ ID NO: 10), MOMP VD2 of serovar F (position 4 and/or 21 of SEQ ID NO: 14), MOMP VD2 of serovar D (position 17 of SEQ ID NO: 6); MOMP VD2 of serovar G (position 4 and/or 21 of SEQ ID NO: 18), MOMP VD4 of serovar E (position 14 in SEQ ID NO: 12); MOMP VD4 of serovar G (position 14 in SEQ ID NO: 20); MOMP VD4 of serovar D (position 14 in SEQ ID NO: 8) and/or MOMP VD4 of serovar F (position 14 in SEQ ID NO: 16), wherein serovars D-G are of *C. trachomatis*. In some embodiments, the chimeric MOMP VD polypeptide comprises (i) a MOMP VD1 sequence from serovar E and a MOMP VD1 sequence from serovar G; and (ii) a MOMP VD2 sequence from serovar D and a MOMP VD2 sequence from serovar G; and (iii) a MOMP VD3 sequence from serovar F; and (iv) a MOMP VD4 sequence from serovar D and a MOMP VD4 sequence from serovar F, wherein the serovars D, E, F or G are of *C. trachomatis*. Typically, the chimeric MOMP VD polypeptide comprises a single amino acid substitution at each of the amino acid residues corresponding to position 9 of SEQ ID NO: 9 (e.g., N to A substitution), position 11 of SEQ ID NO: 17 (e.g., T to A substitution), position 17 of SEQ ID NO: 6 (e.g., S to A substitution), positions 4 and 21 of SEQ ID NO: 18 (e.g., N to A and S to A substitutions, respectively), position 14 of SEQ ID NO: 8 (e.g., a T to A substitution) and position 14 in SEQ ID NO: 16 (e.g., T to A substitution).

In some embodiments, the *Chlamydia* sp. CT443 polypeptide described herein comprises a single amino acid substitution at one or more (e.g., all) positions corresponding to an N-glycosylation site in a native *Chlamydia* sp. CT443 polypeptide. In some embodiments, the *Chlamydia* sp. CT443 polypeptide comprises one or more (e.g., all) single amino acid substitutions at positions corresponding to residues 18, 29 and 435 of SEQ ID NO: 507.

In some embodiments, the *Chlamydia* sp. CT584 polypeptide described herein comprises a single amino acid substitution at one or more (e.g., all) positions corresponding to an N-glycosylation site in a native *Chlamydia* sp. CT584 polypeptide. Typically, the *Chlamydia* sp. CT584 polypeptide comprises a single amino acid substitution at a position corresponding to residue 11 of SEQ ID NO: 509 (e.g., a N to Q substitution).

In some embodiments, the *Chlamydia* sp. CT600 polypeptide described herein comprises a single amino acid substitution at one or more (e.g., all) positions corresponding to an N-glycosylation site in a native *Chlamydia* sp. CT600 polypeptide. In some embodiments, the *Chlamydia* sp. CT600 polypeptide comprises one or two single amino acid substitutions at positions corresponding to residues 48 and 65 of SEQ ID NO: 513.

In some embodiments, the *Chlamydia* sp. CT812 polypeptide described herein comprises a single amino acid substitution at one or more (e.g., all) positions corresponding to an N-glycosylation site in a native *Chlamydia* sp. CT812 polypeptide.

Secretion Signal Peptide Sequences

The modified MOMP polypeptide, the chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein may comprise a secretion signal peptide sequence. The secretion signal peptide may be cleaved in post-translation processing of the *Chlamydia* sp. polypeptides described herein. The mature form of the *Chlamydia* sp. polypeptide may therefore not comprise the secretion signal peptide sequence. However, a nucleotide sequence encoding a secretion signal peptide sequence may be present in nucleic acids described herein encoding the *Chlamydia* sp. polypeptides described herein.

The modified MOMP polypeptide, the chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein may comprise a secretion signal peptide sequence of the respective native *Chlamydia* sp. polypeptide. This may be advantageous if the *Chlamydia* sp. polypeptides are expressed in a prokaryotic cell as recombinant proteins.

In some embodiments, the modified MOMP polypeptide, the chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein may comprise viral or eukaryotic (e.g., human) secretion signal peptide (SS) sequences. The use of viral or eukaryotic secretion signal peptide sequences attached to a polypeptide described herein may offer numerous advantages for immunogenic compositions. When expressed from an mRNA, especially in a eukaryotic cell, a polypeptide of the invention comprising a SS sequence may have increased extracellular expression relative to the polypeptide without the SS sequence. The increased extracellular expression may promote higher immunogenicity and by extension, better vaccine efficacy.

Viral SS sequences may be found in publicly accessible databases (e.g., the NCBI or UniProt databases) which include an annotated viral polypeptide sequence and identify the start and end position of an experimentally validated SS.

In certain embodiments, the SS sequence as well as the location of the SS sequence cleavage site for a given known input polypeptide sequence may be predicted by using the SignalP algorithm. The SignalP algorithm (and more particularly SignalP v6.0) is described in further detail in Armenteros et al. (Nature Biotechnology. 37: 420-423. 2019), Teufel et al. (Nature Biotechnology. 40: 1023-1025. 2022), and https://services.healthtech.dtu.dk/services/SignalP-6.0/, each of which is incorporated herein by reference in their entirety. The strength of the prediction is assessed based on a cumulative rank score that considers the likelihood of detecting canonical features of the signal sequence (SS likelihood score) and the probability of cleavage at the cleavage site (cleavage probability score). In certain embodiments, the viral secretion signal peptide has a SignalP cleavage probability score of at least 0.8, at least 0.85, at least 0.90 or at least 0.95, as determined using SignalP 6.0. In some embodiments, the viral secretion signal peptide has a SignalP signal peptide likelihood score of at least 0.8, at least 0.85, at least 0.90 or at least 0.95, as determined using SignalP 6.0.

In certain embodiments, the SS sequence is a viral SS sequence. In certain embodiments, the viral secretion signal peptide sequence is derived from a viral sequence in a virus able to infect humans. The phrase "influenza", "SARS CoV-2", "varicella-zoster virus (VZV)", "measles", "rubella", "rabies," "Ebola," and "smallpox" preceding the phrase "secretion signal peptide sequence" indicates that the secretion signal peptide was derived from the virus corresponding to that name.

In certain embodiments, the viral secretion signal peptide is derived from a viral sequence selected from the group consisting of: an influenza secretion signal peptide sequence, a SARS CoV-2 secretion signal peptide sequence, a varicella-zoster virus (VZV) secretion signal peptide sequence, a measles secretion signal peptide sequence, a rubella secretion signal peptide sequence, a mumps secretion signal peptide sequence, an Ebola secretion signal peptide sequence, a rabies secretion signal peptide sequence, and a smallpox secretion signal peptide sequence. These particular signal peptides are derived from viral sequences in viruses which have been administered to humans as vaccines (live-attenuated, inactivated or mRNA), with demonstrated strong safety profiles.

In certain embodiments, the viral secretion signal peptide is selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, a rabies virus glycoprotein (Rabies G) secretion signal peptide sequence, and a smallpox 61 kDa IC protein secretion signal peptide sequence.

In certain embodiments, the viral secretion signal peptide comprises an HA secretion signal peptide sequence from influenza A or influenza B, e.g., from influenza A.

Exemplary viral secretion signal peptide amino acid sequences of the disclosure are shown below in Table 2. Exemplary viral secretion signal peptide amino acid sequences derived from Influenza A or B of the disclosure are shown below in Table 2.1.

TABLE 2

Viral Secretion Signal Peptide (SS) Amino Acid Sequences

| NAME OF THE PROTEIN | ORGANISM | STRAIN | SEQUENCE OF THE SS |
|---|---|---|---|
| HA (H1N1) | Influenza virus | A/New Caledonia/ 20/1999 | MKAKLLVLLCTFTATYA (SEQ ID NO: 187) |
| HA (H1N1pdm) | Influenza virus | A/California/7/ 2009 | MKAILVVLLYTFATANA (SEQ ID NO: 188) |
| HA (H3N2) | Influenza virus | A/Moscow/10/ 1999 | MKTIIALSYILCLVFA (SEQ ID NO: 193) |
| HA B | Influenza virus | B/Phuket/3073/ 2013 | MKAIIVLLMVVTSNA (SEQ ID NO: 194) |
| Spike | SARS CoV-2 | Wuhan-1 | MFVFLVLLPLVS (SEQ ID NO: 195) |
| Spike | SARS CoV-2 | Wuhan-1 (long version) | MFLLTTKRTMFVFLVLLPLVS (SEQ ID NO: 196) |
| gB | VZV | Oka strain | MSPCGYYSKWRNRDRPEYRRNLRFRRFFSSIHPNAAAGSGFNGPGVFITSVTGVWLCFLCIFSMFVTAVVS (SEQ ID NO: 803) |
| gE | VZV | Oka strain | MGTVNKPVVGVLMGFGIITGTLRITNPVRA (SEQ ID NO: 804) |
| gI | VZV | Oka strain | MFLIQCLISAVIFYIQVTNA (SEQ ID NO: 805) |
| gK | VZV | Oka strain | MQALGIKTEHFIIMCLLSGHA (SEQ ID NO: 806) |
| F | Measles | Edmonston-Zagreb strain | MGLKVNVSAIFMAVLLTLQTPTG (SEQ ID NO: 807) |
| E1 | Rubella | RA27/3 strain | MGAAAALTAVVLQGYNPPAYG (SEQ ID NO: 808) |
| E2 | Rubella | RA27/3 strain | MGAPQAFLAGLLLAAVAVGTARA (SEQ ID NO: 809) |
| F | Mumps | Miyahara strain | MKVFLVTCLGFAVFSSSVC (SEQ ID NO: 810) |
| GP | Ebola | Mayinga-76 strain | MGVTGILQLPRDRFKRTSFFLWVIILFQRTFS (SEQ ID NO: 811) |
| 6 kDa IC | Smallpox | Germany 91-3 strain | MRSLIIFLLFPSIIYS (SEQ ID NO: 812) |
| Rabies G | Rabies | Rabies Pasteur strain | MVPQALLFVPLLVFPLCFG (SEQ ID NO: 845) |

TABLE 2.1

Influenza virus A and B Specific Viral Secretion
Signal Peptide (SS) Amino Acid Sequences

| STRAIN NAME OR ID | SEQUENCE OF THE SS |
| --- | --- |
| A/Beijing/262/95 (H1N1)-like virus | MKAKLLVLLCTFTATYA (SEQ ID NO: 187) |
| A/Brisbane/02/2018 (H1N1)pdm09-like virus | MKAILVVLLYTFTTANA (SEQ ID NO: 846) |
| A/Brisbane/59/2007 (H1N1)-like virus | MKVKLLVLLCTFTATYA (SEQ ID NO: 847) |
| A/California/7/2009 (H1N1)-like virus | MKAILVVLLYTFATANA (SEQ ID NO: 188) |
| A/Guangdong-Maonan/SWL1536/2019 (H1N1)pdm09-like virus | MKAILVVLLYTFTTANA (SEQ ID NO: 846) |
| A/Hawaii/70/2019 (H1N1)pdm09-like virus | MKAILVVLLYTFTTANA (SEQ ID NO: 846) |
| A/Michigan/45/2015 (H1N1)pdm09-like virus | MKAILVVLLYTFTTANA (SEQ ID NO: 846) |
| A/New Caledonia/20/99 (H1N1)-like virus | MKAKLLVLLCTFTATYA (SEQ ID NO: 187) |
| A/Solomon Islands/3/2006 (H1N1)-like virus | MKVKLLVLLCTFTATYA (SEQ ID NO: 847) |
| A/Sydney/5/2021 (H1N1)pdm09-like virus | MKAILVVMLYTFTTANA (SEQ ID NO: 848) |
| A/Victoria/2570/2019 (H1N1)pdm09-like virus | MKAILVVMLYTFTTANA (SEQ ID NO: 848) |
| A/Victoria/4897/2022 (H1N1)pdm09-like virus | MKAILVVMLYTFTTANA (SEQ ID NO: 848) |
| A/Wisconsin/588/2019 (H1N1)pdm09-like virus | MKAILVVMLYTFTTANA (SEQ ID NO: 848) |
| A/Wisconsin/67/2022 (H1N1)pdm09-like virus | MKAILVVMLYTFTTANA (SEQ ID NO: 848) |
| H1N1 CONSENSUS SEQ #1 (without substitutions) | MKAILVVLLYTFTTANA (SEQ ID NO: 846) |
| A/Brisbane/10/2007 (H3N2)-like virus | MKTIIALSYILCLVFT (SEQ ID NO: 849) |
| A/California/7/2004 (H3N2)-like virus | MKTIIALSYILCLVFA (SEQ ID NO: 193) |
| A/Cambodia/e0826360/2020 (H3N2)-like virus | MKTIIALSYILCLVFA (SEQ ID NO: 193) |
| A/Darwin/6/2021 (H3N2)-like virus | MKTIIALSNILCLVFA (SEQ ID NO: 850) |
| A/Darwin/9/2021 (H3N2)-like virus | MKTIIALSNILCLVFA (SEQ ID NO: 850) |
| A/Fujian/411/2002 (H3N2)-like virus | MKTIIALSYILCLVFA (SEQ ID NO: 193) |
| A/Hong Kong/2671/2019 (H3N2)-like virus | MKAIIALSNILCLVFA (SEQ ID NO: 851) |
| A/Hong Kong/45/2019 (H3N2)-like virus | MKAIIALSNILCLVFA (SEQ ID NO: 851) |
| A/Hong Kong/4801/2014 (H3N2)-like virus | MKTIIALSYILCLVFA (SEQ ID NO: 193) |
| A/Kansas/14/2017 (H3N2)-like virus | MKTIIALSCILCLVFA (SEQ ID NO: 852) |

TABLE 2.1-continued

Influenza virus A and B Specific Viral Secretion
Signal Peptide (SS) Amino Acid Sequences

| STRAIN NAME OR ID | SEQUENCE OF THE SS |
| --- | --- |
| A/Moscow/10/99 (H3N2)-like virus | MKTIIALSYILCLVFA (SEQ ID NO: 193) |
| A/Perth/16/2009 (H3N2)-like virus | MKTIIALSYILCLVFA (SEQ ID NO: 193) |
| A/Singapore/INFIMH-16-0019/2016 (H3N2)-like virus | MKTIIALSYILCLVFA (SEQ ID NO: 193) |
| A/South Australia/34/2019 (H3N2)-like virus | MKTIIALSYILCLVFA (SEQ ID NO: 193) |
| A/Switzerland/8060/2017 (H3N2)-like virus | MKTIIALSYILCLVFA (SEQ ID NO: 193) |
| A/Switzerland/9715293/2013 (H3N2)-like virus | MKTHALSYILCLVFA (SEQ ID NO: 193) |
| A/Sydney/5/97 (H3N2)-like virus | MKTIIALSYILCLVFA (SEQ ID NO: 193) |
| A/Texas/50/2012 (H3N2)-like virus | MKTIIALSYILCLVFA (SEQ ID NO: 193) |
| A/Victoria/361/2011 (H3N2)-like virus | MKTIIALSHILCLVFA (SEQ ID NO: 853) |
| A/Wellington/1/2004 (H3N2)-like virus | MKTIIALSYILCLVFA (SEQ ID NO: 193) |
| A/Wisconsin/67/2005 (H3N2)-like virus | MKTHALSYILCLVFA (SEQ ID NO: 193) |
| H3N2 CONSENSUS SEQ #1 (without substitutions) | MKTIIALSYILCLVFA (SEQ ID NO: 193) |
| B/Austria/1359417/2021 (B/Victoria lineage)-like | MKAIIVLLMVVTSNA (SEQ ID NO: 194) |
| B/Brisbane/60/2008-like virus | MKAIIVLLMVVTSNA (SEQ ID NO: 194) |
| B/Colorado/06/2017-like virus (B/Victoria/2/87 lineage) | MKAIIVLLMVVTSSA (SEQ ID NO: 854) |
| B/Hong Kong/330/2001-like virus | MKAIIVLLMVVTSNA (SEQ ID NO: 194) |
| B/Malaysia/2506/2004-like virus | MKAIIVLLMVVTSNA (SEQ ID NO: 194) |
| B/Washington/02/2019 (B/Victoria lineage)-like virus | MKAIIVLLMVVTSNA (SEQ ID NO: 194) |
| B/Beijing/184/93-like virus | MKAIIVLLMVVTSNA (SEQ ID NO: 194) |
| B/Florida/4/2006-like virus | MKAIIVLLMVVTSNA (SEQ ID NO: 194) |
| B/Massachusetts/2/2012-like virus | MKAIIVLLMVVTSNA (SEQ ID NO: 194) |
| B/Phuket/3073/2013-like virus | MKAIIVLLMVVTSNA (SEQ ID NO: 194) |
| B/Sichuan/379/99-like virus | MEAIIVLLMVVTSNA (SEQ ID NO: 855) |
| INFLUENZA B VICTORIA/YAMAGAT | MKAIIVLLMVVTSNA (SEQ ID NO: 194) |

TABLE 2.1-continued

Influenza virus A and B Specific Viral Secretion Signal Peptide (SS) Amino Acid Sequences

| STRAIN NAME OR ID | SEQUENCE OF THE SS |
|---|---|
| A CONSENSUS SEQUENCE (without substitutions) | |
| H1N1 CONSENSUS SEQ #2 (with substitutions) | MKX$_1$X$_2$LX$_3$VX$_4$LX$_5$TFX$_6$X$_7$X$_8$X$_9$A<br>X$_1$ is selected from A and V;<br>X$_2$ is selected from I and K;<br>X$_3$ is selected from V and L;<br>X$_4$ is selected from L and M;<br>X$_5$ is selected from Y and C;<br>X$_6$ is selected from T and A<br>X$_7$ is selected from T and A;<br>X$_8$ is selected from A and T;<br>and X$_9$ is selected from N and Y<br>(SEQ ID NO: 856) |
| H3N2 CONSENSUS SEQ #2 (with substitutions) | MKXIIALSX$_2$ILCLVFX$_3$<br>X$_1$ is selected from T and A;<br>X$_2$ is selected from Y, N, C, and H; and X$_3$ is selected from T and A<br>(SEQ ID NO: 857) |
| INFLUENZA B VICTORIA CONSENSUS SEQ (with substitutions) | MKAIIVLLMVVTSXIA<br>X$_1$ is selected from S and N<br>(SEQ ID NO: 858) |
| INFLUENZA B YAMAGATA CONSENSUS SEQ (with substitutions) | MX$_1$AIIVLLMVVTSNA<br>X$_1$ is selected from K and E<br>(SEQ ID NO: 859) |

The secretion signal peptide sequence may be positioned at the N terminus or the C terminus (e.g., at the N terminus) of a polypeptide described herein.

In certain embodiments, the SS amino acid sequence is encoded by a codon-optimized polynucleotide sequence.

In certain embodiments, the viral secretion signal peptide is derived from a viral sequence in a virus able to infect humans.

In certain embodiments, the viral secretion signal peptide is derived from a viral sequence selected from the group consisting of: an influenza secretion signal peptide sequence, and a non-influenza secretion signal peptide sequence selected from the group consisting of a SARS CoV-2 secretion signal peptide sequence, a varicella-zoster virus (VZV) secretion signal peptide sequence, a measles secretion signal peptide sequence, a rubella secretion signal peptide sequence, a mumps secretion signal peptide sequence, an Ebola secretion signal peptide sequence, a smallpox secretion signal peptide sequence, and a rabies secretion signal peptide sequence.

In certain embodiments, the viral secretion signal peptide is selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, a smallpox 6 kDa IC protein secretion signal peptide sequence, and a rabies G protein secretion signal peptide sequence, e.g., wherein the viral secretion signal peptide comprises an HA secretion signal peptide sequence from influenza A or influenza B, e.g., from influenza A.

In certain embodiments, the HA secretion signal peptide sequence comprises an amino acid sequence MKX1X2LX3VX4LX5TFX6X7X8X9A (SEQ ID NO: 856) wherein X1 is selected from A and V; X2 is selected from I and K; X3 is selected from V and L; X4 is selected from L and M; X5 is selected from Y and C; X6 is selected from T and A X7 is selected from T and A; X8 is selected from A and T; and X9 is selected from N and Y.

In certain embodiments, the HA secretion signal peptide sequence comprises an amino acid sequence selected from MKAKLLVLLCTFTATYA (SEQ ID NO: 187), MKAIL-VVLLYTFTTANA (SEQ ID NO: 846), MKVKLL-VLLCTFTATYA (SEQ ID NO: 847), MKAILVVLLYTFA-TANA (SEQ ID NO: 188) and MKAILVVMLYTFTTANA (SEQ ID NO: 848).

In certain embodiments, the HA secretion signal peptide sequence comprises an amino acid sequence MKXIIALSX2ILCLVFX3 (SEQ ID NO: 857) wherein X1 is selected from T and A; X2 is selected from Y, N, C, and H; and X3 is selected from T and A.

In certain embodiments, the HA secretion signal peptide sequence comprises an amino acid sequence selected from MKTIIALSYILCLVFT (SEQ ID NO: 849), MKTIIAL-SYILCLVFA (SEQ ID NO: 193), MKTIIALSNILCLVFA (SEQ ID NO: 850), MKAIIALSNILCLVFA (SEQ ID NO: 851), MKTIIALSCILCLVFA (SEQ ID NO: 852) and MKTIIALSHILCLVFA (SEQ ID NO: 853).

In certain embodiments, the HA secretion signal peptide sequence comprises an amino acid sequence MKAIIVLLMVVTSX1A (SEQ ID NO: 858) wherein X1 is selected from S and N.

In certain embodiments, the HA secretion signal peptide sequence comprises an amino acid sequence MX1AIIVLLMVVTSNA (SEQ ID NO: 859) wherein X1 is selected from K and E.

In certain embodiments, the HA secretion signal peptide sequence comprises an amino acid sequence selected from MKAIIVLLMVVTSNA (SEQ ID NO: 194), MKAIIVLLMVVTSSA (SEQ ID NO: 854), and MEAIIVLLMVVTSNA (SEQ ID NO: 855).

In certain embodiments, the viral secretion signal peptide comprises an amino acid sequence selected from the group consisting of: MKAKLLVLLCTFTATYA (SEQ ID NO: 187); MKAILVVLLYTFATANA (SEQ ID NO: 188); MKTIIALSYILCLVFA (SEQ ID NO: 193); MKAIIVLLMVVTSNA (SEQ ID NO: 194); MFVFLVLLPLVS (SEQ ID NO: 195); MFLLTTKRTMFVFLVLLPLVS (SEQ ID NO: 196) MSPCGYYSKWRNRDRPEYRRNLRFRRFFSSIHPNAAAGSGFNGPGVFITSVTGVWLCFLCIFSMFVTAVVS (SEQ ID NO: 803); MGTVNKPVVGVLMGFGIITGTLRITNPVRA (SEQ ID NO: 804); MFLIQCLISAVIFYIQVTNA (SEQ ID NO: 805); MQALGIKTEHFIIMCLLSGHA (SEQ ID NO: 806); MGLKVNVSAIFMAVLLTLQTPTG (SEQ ID NO: 807); MGAAAALTAVVLQGYNPPAYG (SEQ ID NO: 808); MGAPQAFLAGLLLAAVAVGTARA (SEQ ID NO: 809); MKVFLVTCLGFAVFSSSVC (SEQ ID NO: 810); MGVTGILQLPRDRFKRTSFFLWVIILFQRTFS (SEQ ID NO: 811); MRSLIIFLLFPSIIYS (SEQ ID NO: 812); and MVPQALLFVPLLVFPLCFG (SEQ ID NO: 845).

In certain embodiments, the viral secretion signal peptide comprises an amino acid sequence of MKAKLLVLLCTFTATYA (SEQ ID NO: 187).

In certain embodiments, the viral secretion signal peptide is positioned at the N-terminus of the antigenic prokaryotic polypeptide. In certain embodiments, the viral secretion signal peptide is positioned at the N-terminus of the polypeptide disclosed herein.

In certain embodiments, the viral secretion signal peptide is positioned at the C-terminus of the antigenic prokaryotic polypeptide. In certain embodiments, the viral secretion signal peptide is positioned at the C-terminus of the polypeptide disclosed herein.

In certain embodiments, the viral secretion signal peptide is attached to the antigenic prokaryotic polypeptide with a linker. In certain embodiments, the viral secretion signal peptide is attached to the polypeptide disclosed herein with a linker.

Heterologous Transmembrane Domains (TMBs)

The chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide as described herein may comprise a heterologous transmembrane domain. The inclusion of a TMB may be advantageous as this will localise the antigen to the cell membrane. This may reduce antigen intracellular localisation and further promote higher immunogenicity relative to the antigen without the TMB sequence. The chimeric *Chlamydia* sp. MOMP VD polypeptide, *Chlamydia* sp. CT443 polypeptide, *Chlamydia* sp. CT584 polypeptide, *Chlamydia* sp. CT600 polypeptide and/or *Chlamydia* sp. CT812 polypeptide comprising a heterologous transmembrane domain may also comprise a secretion signal peptide sequence. Typically, a nucleic acid described herein encoding the chimeric *Chlamydia* sp. MOMP VD polypeptide that comprises a heterologous transmembrane domain also comprises a nucleotide sequence encoding a secretion signal peptide sequence. Typically, a nucleic acid described herein encoding the *Chlamydia* sp. CT443 polypeptide that comprises a heterologous transmembrane domain also comprises a nucleotide sequence encoding a secretion signal peptide sequence. Typically, a nucleic acid described herein encoding the *Chlamydia* sp. CT584 polypeptide that comprises a heterologous transmembrane domain also comprises a nucleotide sequence encoding a secretion signal peptide sequence. Typically, a nucleic acid described herein encoding the *Chlamydia* sp. CT600 polypeptide that comprises a heterologous transmembrane domain also comprises a nucleotide sequence encoding a secretion signal peptide sequence. Typically, a nucleic acid described herein encoding the *Chlamydia* sp. CT812 polypeptide that comprises a heterologous transmembrane domain also comprises a nucleotide sequence encoding a secretion signal peptide sequence.

The TMB may be from any known TMB in the art, including but not limited to, TMBs from eukaryotic transmembrane proteins (e.g., mammalian transmembrane proteins, such as human transmembrane proteins), TMBs from prokaryotic transmembrane proteins, and TMBs from viral transmembrane proteins. TMBs may further be identified through in silico prediction algorithms, for example, in the TMHMM prediction method described in Krogh et al. (J Mol Biol. 305(3): 567-580. 2001) and services. healthtech.dtu.dk/services/TMHMM-2.0/, each of which is incorporated herein by reference in their entirety. Some features of TMBs are described in further detail in Albers et al. (Chapter 2—cell membrane structures and functions. Basic Neurochemistry eighth edition. Pages 26-39. 2012), incorporated herein by reference. TMBs are typically, but not exclusively, comprised predominantly of nonpolar (hydrophobic) amino acid residues and may traverse a lipid bilayer once or several times. The skilled person knows well methods to determine the hydrophobicity of an amino acid. See Simm et al. (2016), Biol Res., 49(1):31; Wimlet and White (1996), Nat Struct Biol., 3(10): 842-848; blanco.biomol.uci.edu/hydrophobicity_scales.html; and cgl.ucsf.edu/chimera/docs/UsersGuide/midas/hydrophob.html.

The TMBs usually comprise alpha helices, each helix containing 18-21 amino acids, which is sufficient to span the lipid bilayer. Accordingly, in certain embodiments, the transmembrane domain comprises one or more alpha helices. In some embodiments, the TMB: (a) comprises or consists of 15 to 50 amino acid residues, e.g., 15 to 30 amino acid residues, e.g., 18 to 25 amino acid residues; and/or (b) comprises at least 50%, at least 55%, or at least 60% of hydrophobic amino acid residues, e.g., selected in the group consisting of: alanine, isoleucine, leucine, valine, phenylalanine, tryptophane and tyrosine; and/or (c) comprises at least one alpha helix.

In certain embodiments, the transmembrane domain is derived from an integral membrane protein, as further defined hereafter and in Albers et al., An "integral membrane protein" (also known as an intrinsic membrane protein) is a membrane protein that is permanently attached to the lipid membrane. In certain embodiments, the transmembrane domain is derived from an integral polytopic protein. An integral polytopic protein is one that spans the entire membrane. In certain embodiments, the transmembrane domain is derived from a single pass (trans)membrane protein, more particularly a bitopic membrane protein, e.g., of Type I or Type II. Single-pass membrane proteins cross the membrane only once (i.e., a bitopic membrane protein), while multi-pass membrane proteins weave in and out, crossing several times.

Single pass transmembrane proteins can be categorized as Type I, which are positioned such that their carboxyl-terminus is towards the cytosol, or Type II, which have their amino-terminus towards the cytosol. In certain embodiments, the transmembrane domain is derived from an integral monotopic protein. An integral monotopic protein is one that is associated with the membrane from only one side and does not span the lipid bilayer completely.

In certain embodiments, the heterologous transmembrane domain is derived from a non-human sequence.

In certain embodiments, the heterologous transmembrane domain is derived from a viral sequence. The phrase "influenza", "SARS CoV-2", "varicella-zoster virus (VZV)", "measles", "rubella", "rabies," "Ebola," and "smallpox" preceding the phrase "transmembrane domain sequence" indicates that the transmembrane domain sequence was derived from the virus corresponding to that name.

In certain embodiments, the heterologous transmembrane domain is derived from a viral transmembrane domain sequence selected from the group consisting of: an influenza transmembrane domain sequence, a SARS CoV-2 transmembrane domain sequence, a varicella-zoster virus (VZV) transmembrane domain sequence, a measles transmembrane domain sequence, a rubella transmembrane domain sequence, a mumps transmembrane domain sequence, a rabies transmembrane domain sequence, and an Ebola transmembrane domain sequence. These particular transmembrane domains are derived from viral sequences in viruses which have been administered to humans as vaccines (live-attenuated, inactivated or mRNA), with demonstrated strong safety profiles.

In certain embodiments, the heterologous transmembrane domain is selected from the group consisting of: an influenza hemagglutinin (HA) transmembrane domain sequence, a SARS CoV-2 spike transmembrane domain sequence, a VZV gB transmembrane domain sequence, a VZV gE transmembrane domain sequence, a VZV gI transmembrane domain sequence, a VZV gK transmembrane domain sequence, a measles F-protein transmembrane domain sequence, a rubella E1 protein transmembrane domain sequence, a rubella E2 protein transmembrane domain sequence, a mumps F-protein transmembrane domain sequence, a rabies virus glycoprotein (Rabies G) transmembrane domain sequence, and an Ebola GP protein transmembrane domain sequence.

In certain embodiments, the heterologous transmembrane domain comprises an HA transmembrane domain sequence from influenza A or influenza B, e.g., from influenza A.

Exemplary viral transmembrane domain amino acid sequences of the disclosure are shown below in Table 3.

TABLE 3

Viral Transmembrane Domain (TMB) Signal Amino Acid Sequences

| NAME OF THE PROTEIN | ORGANISM | STRAIN | SEQUENCE OF THE TMB |
|---|---|---|---|
| HA (H1N1) | Influenza virus | A/New Caledonia/20/1999 | ILAIYSTVASSLVLLVSLGAISF (SEQ ID NO: 813) |
| HA (H1N1pdm) | Influenza virus | A/California/7/2009 | ILAIYSTVASSLVLVVSLGAISF (SEQ ID NO: 814) |
| HA (H3N2) | Influenza virus | A/Moscow/10/1999 | ILWISFAISCFLLCVVLLGFI (SEQ ID NO: 815) |
| HA B | Influenza virus | B/Phuket/3073/2013 | STAASSLAVTLMLAIFIVYMV (SEQ ID NO: 816) |
| Spike | SARS CoV-2 | Wuhan-1 | WYIWLGFIAGLIAIVMVTIML (SEQ ID NO: 817) |
| gB | VZV | Oka strain | FGALAVGLLVLAGLVAAFFAY (SEQ ID NO: 818) |
| gE | VZV | Oka strain | AAWTGGLAAVVLLCLVIFLIC (SEQ ID NO: 819) |
| gI | VZV | Oka strain | IIIPIVASVMILTAMVIVIVI (SEQ ID NO: 820) |
| gK | VZV | Oka strain | YFWCVQLKMIFFAWFVYGMYL (SEQ ID NO: 821) |
| F | Measles | Edmonston-Zagreb strain | IVYILIAVCLGGLIGIPALIC (SEQ ID NO: 822) |
| E1 | Rubella | RA27/3 strain | LDHAFAAFVLLVPWVLIFMVC (SEQ ID NO: 823) |
| E2 | Rubella | RA27/3 strain | WWQLTLGAICALLLAGLLACC (SEQ ID NO: 824) |
| F | Mumps | Miyahara strain | IVAALVLSILSIIISLLFCCW (SEQ ID NO: 825) |

TABLE 3-continued

Viral Transmembrane Domain (TMB) Signal Amino Acid Sequences

| NAME OF THE PROTEIN | ORGANISM | STRAIN | SEQUENCE OF THE TMB |
|---|---|---|---|
| GP | Ebola | Mayinga-76 strain | WIPAGIGVTGVIIA VIALFCI (SEQ ID NO: 826) |
| Rabies G | Rabies | Rabies Pasteur strain | VLLSAGALTALMLIIFLMTCW (SEQ ID NO: 860) |

In certain embodiments, the heterologous TMB sequence is positioned at the N-terminus or the C-terminus (e.g., C-terminus) of a polypeptide described herein.

In certain embodiments, the TMB amino acid sequence is encoded by a codon-optimized polynucleotide sequence.

In some embodiments, the chimeric MOMP VD polypeptide comprises a heterologous transmembrane domain as described herein. In some embodiments, the heterologous transmembrane domain does not comprise the sequence of SEQ ID NO: 189. In some embodiments, the heterologous transmembrane domain comprises the sequence of SEQ ID NO: 190. Typically, the chimeric MOMP VD polypeptide does not comprise a heterologous transmembrane domain.

In alternative embodiments, one or more of the chimeric MOMP VD polypeptide, the *Chlamydia* sp. CT443 polypeptide, the *Chlamydia* sp. CT584 polypeptide, the *Chlamydia* sp. CT600 polypeptide and/or *Chlamydia* sp. CT812 polypeptide as described herein do not comprise a heterologous transmembrane domain. Such polypeptides may comprise a secretion signal peptide sequence. In further embodiments, the polypeptides of the invention are secreted. In some embodiments, the chimeric MOMP VD polypeptide described herein is a secreted polypeptide. In some embodiments, the *Chlamydia* sp. CT443 polypeptide described herein is a secreted polypeptide. In some embodiments, the *Chlamydia* sp. CT584 polypeptide described herein is a secreted polypeptide. In some embodiments, the *Chlamydia* sp. CT600 polypeptide described herein is a secreted polypeptide. In some embodiments, the *Chlamydia* sp. CT812 polypeptide described herein is a secreted polypeptide. In exemplary embodiments, the modified MOMP polypeptide described herein is a secreted polypeptide. Secreted polypeptides described herein comprise a secretion signal peptide sequence.

In certain embodiments the TMB: (a) comprises or consists of 15 to 50 amino acid residues, e.g., 15 to 30 amino acid residues, e.g., 18 to 25 amino acid residues; and/or (b) comprises at least 50% of hydrophobic amino acid residues, e.g., selected in the group consisting of: alanine, isoleucine, leucine, valine, phenylalanine, tryptophane and tyrosine; and/or (c) comprises at least one alpha helix.

In certain embodiments the TMB is derived from an integral membrane protein, such as from a single pass membrane protein, e.g., from a bitopic membrane protein (e.g., from a bitopic membrane protein of Type I).

In certain embodiments the TMB is derived from a non-human sequence.

In certain embodiments, the TMB is derived from a viral sequence.

In certain embodiments, the TMB is derived from a viral transmembrane domain sequence selected from the group consisting of: an influenza transmembrane domain sequence, and a non-influenza transmembrane domain sequence selected from the group consisting of a SARS CoV-2 transmembrane domain sequence, a varicella-zoster virus (VZV) transmembrane domain sequence, a measles transmembrane domain sequence, a rubella transmembrane domain sequence, a mumps transmembrane domain sequence, an Ebola transmembrane domain sequence, and a rabies transmembrane domain sequence.

In certain embodiments, the TMB is selected from the group consisting of: an influenza hemagglutinin (HA) transmembrane domain sequence, a SARS CoV-2 spike transmembrane domain sequence, a VZV gB transmembrane domain sequence, a VZV gE transmembrane domain sequence, a VZV gI transmembrane domain sequence, a VZV gK transmembrane domain sequence, a measles F-protein transmembrane domain sequence, a rubella E1 protein transmembrane domain sequence, a rubella E2 protein transmembrane domain sequence, a mumps F-protein transmembrane domain sequence, an Ebola GP protein transmembrane domain sequence, and a rabies G protein transmembrane domain sequence. In exemplary embodiments, the TMB comprises an HA transmembrane domain sequence from influenza A or influenza B, e.g., from influenza A.

In certain embodiments, the TMB comprises an amino acid sequence selected from the group consisting of: ILAIYSTVASSLVLLVSLGAISF (SEQ ID NO: 813); ILAIYSTVASSLVLVVSLGAISF (SEQ ID NO: 814); ILWISFAISCFLLCVVLLGFI (SEQ ID NO: 815); STAASSLAVTLMLAIFIVYMV (SEQ ID NO: 816); WYIWLGFIAGLIAIVMVTIML (SEQ ID NO: 817); FGALAVGLLVLAGLVAAFFAY (SEQ ID NO: 818); AAWTGGLAAVVLLCLVIFLIC (SEQ ID NO: 819); IIIPIVASVMILTAMVIVIVI (SEQ ID NO: 820); YFWCVQLKMIFFAWFVYGMYL (SEQ ID NO: 821); IVYILIAVCLGGLIGIPALIC (SEQ ID NO: 822); LDHAFAAFVLLVPWVLIFMVC (SEQ ID NO: 823); WWQLTLGAICALLLAGLLACC (SEQ ID NO: 824); IVAALVLSILSIIISLLFCCW (SEQ ID NO: 825); WIPAGIGVTGVIIAVIALFCI (SEQ ID NO: 826); and VLLSAGALTALMLIIFLMTCW (SEQ ID NO: 860).

In certain embodiments, the TMB comprises an amino acid sequence of ILAIYSTVASSLVLLVSLGAISF (SEQ ID NO: 813).

In certain embodiments, the TMB is attached to a polypeptide described herein with a linker.

In certain embodiments, the TMB is positioned at the N-terminus of a polypeptide described herein.

In certain embodiments, the TMB is positioned at the C-terminus of a polypeptide described herein.

Linkers

In certain embodiments of the disclosure, the secretion signal peptide (SS) sequence or transmembrane domain (TMB) are directly fused to a polypeptide described herein (i.e., there is no linker, such as an amino acid linker, connecting the SS sequence or TMB to the polypeptide described herein).

In other embodiments, the SS sequences and TMBs of the disclosure are optionally attached to a polypeptide described herein with a linker. In certain embodiments, the linker is an amino acid linker. In the certain embodiments, the amino acid linker is 1-10 amino acids in length (e.g., the amino acid linker has a length of 1 amino acid, 2 amino acids, 3 amino acids, 4 amino acids, 5 amino acids, 6 amino acids, 7 amino acids, 8 amino acids, 9 amino acids, or 10 amino acids).

Illustrative examples of linkers include glycine polymers (Gly)n, where n is an integer of at least one, two, three, four, five, six, seven, or eight; glycine-serine polymers (GlySer)n, where n is an integer of at least one, two, three, four, five, six, seven, or eight; glycine-alanine polymers; alanine-serine polymers; and other flexible linkers known in the art.

Glycine and glycine-serine polymers are relatively unstructured and flexible, and therefore may be able to serve as a neutral tether between the SS sequence and/or TMB and the polypeptides described herein. In certain embodiments, the linker is SGS or GSG.

Other exemplary linkers include, but are not limited to, the following amino acid sequences: GGG; DGGGS (SEQ ID NO: 827); TGEKP (SEQ ID NO: 828) (Liu et al. Proc. Natl. Acad. Sci. 94: 5525-5530. 1997); GGRR (SEQ ID NO: 829); (GGGGS)n (SEQ ID NO: 830), wherein n=1, 2, 3, 4 or 5 (Kim et al. Proc. Natl. Acad. Sci. 93: 1156-1160. 1996); EGKSSGSGSESKVD (SEQ ID NO: 831) (Chaudhary et al. Proc. Natl. Acad. Sci. 87: 1066-1070. 1990); KESGSVSSE-QLAQFRSLD (SEQ ID NO: 832) (Bird et al. Science. 242:423-426. 1988), GGRRGGGS (SEQ ID NO: 833); LRQRDGERP (SEQ ID NO: 834); LRQKDGGGSERP (SEQ ID NO: 835); and GSTSGSGKPGSGEGSTKG (SEQ ID NO: 836) (Cooper et al. Blood. 101(4): 1637-1644. 2003). Exemplary linkers are shorter, e.g., consisting of 3, 4 or 5 amino acids.

Additional examples of linkers are provided in Chen et al. (Adv Drug Deliv Rev. 65(10): 1357-1369. 2013), incorporated herein by reference.

Compositions

The invention provides a composition comprising one or more nucleic acids of the disclosure. The invention also provides a composition comprising one or more polypeptides of the disclosure. A composition of the invention may be a pharmaceutical composition, e.g., comprising a pharmaceutically acceptable carrier, excipient or diluent. In certain embodiments, the composition of the invention is an immunogenic composition. An "immunogenic composition" means a composition comprising a nucleic acid or protein that, when administered to a subject, elicits an immune response, e.g., an antigen-specific immune response. The response may be a T cell immune response or an antibody response. The composition of the invention may be a vaccine composition. Immunogenic compositions (e.g., vaccine compositions) may elicit protective immunity (e.g., T cell and/or B cell (i.e. antibody) responses) against *Chlamydia* sp. infection. The T cell response may include a CD4+ T cell response and/or a CD8+ T cell response, such as IFNγ-producing CD4+ T cells and/or IFNγ-producing CD8+ T cells. In some embodiments, the T cell response includes CD4+ T cells, such as IFNγ-producing CD4+ T cells.

"Protective immunity" or a "protective immune response", as used herein, refers to immunity or eliciting an immune response against an infectious agent (e.g., a *Chlamydia* pathogen), which is exhibited by a subject, that prevents or ameliorates an infection or reduces at least one symptom thereof. Specifically, induction of protective immunity or a protective immune response from administration of a composition of the invention is evident by elimination or reduction of the presence of one or more symptoms of the *Chlamydia* infection and/or an expansion of the *Chlamydia*-responsive memory T cell population. As used herein, the term "immune response" refers to both the humoral immune response and the cell-mediated immune response. In exemplary embodiments, the protective immunity provided by the invention is characterised by protective immunological memory (e.g., a protective memory T cell response) against the pathogen. The protective immunity may be characterised by an effective pathogen-responsive (e.g., *Chlamydia*-responsive) memory T cell population. In exemplary embodiments, treatment with a composition of the invention as described herein provides protective immunity against re-infection by the *Chlamydia* pathogen. Protective immunity may be sterilising immunity (i.e. complete protective immunity), whereby the protected subject can elicit an immune response which completely eliminates the infection. *Chlamydia* antigens described herein (e.g., the chimeric MOMP VD polypeptides of the invention and the *Chlamydia* sp. CT443 and CT584 polypeptides of the invention) may bind *Chlamydia* sp. (e.g., *C. trachomatis*) elementary bodies, e.g., elementary bodies of two or more serotypes.

Nucleic Acid Compositions

In one aspect the invention provides a composition comprising a nucleic acid as described herein comprising a nucleotide sequence encoding a modified MOMP polypeptide as described herein.

In another aspect, the invention provides a composition comprising a nucleic acid as described herein comprising a nucleotide sequence encoding a chimeric MOMP VD polypeptide as described herein.

In another aspect, the invention provides a composition comprising a nucleic acid as described herein that comprises a nucleotide sequence encoding a *Chlamydia* sp. CT443 polypeptide as described herein.

In another aspect, the invention provides a composition comprising a nucleic acid as described herein that comprises a nucleotide sequence encoding a *Chlamydia* sp. CT584 polypeptide as described herein.

In another aspect, the invention provides a composition comprising a nucleic acid as described herein that comprises a nucleotide sequence encoding a *Chlamydia* sp. CT600 polypeptide as described herein.

In another aspect, the invention provides a composition comprising a nucleic acid as described herein that comprises a nucleotide sequence encoding a *Chlamydia* sp. CT812 polypeptide as described herein.

In a further aspect, the invention provides a composition comprising one, two, three or four of: (a) a nucleic acid as described herein that comprises a nucleotide sequence encoding a *Chlamydia* sp. CT443 polypeptide as described herein; (b) a nucleic acid as described herein that comprises a nucleotide sequence encoding a *Chlamydia* sp. CT584 polypeptide as described herein; (c) a nucleic acid as described herein that comprises a nucleotide sequence encoding a *Chlamydia* sp. CT600 polypeptide as described herein; and/or (d) a nucleic acid as described herein that comprises a nucleotide sequence encoding a *Chlamydia* sp. CT812 polypeptide as described herein.

A composition of the invention may comprise a combination as described herein of the nucleic acids as described herein (e.g., they may be formulated in the same composition). The combinations as described herein of the nucleic acids as described herein may alternatively be in two or more separate compositions (e.g., as a combination of compositions for simultaneous, separate or sequential administration, (e.g., in a therapeutic use as described herein)).

In some embodiments, the composition may comprise (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, and (c) a nucleic acid as described herein comprising a nucleotide sequence encoding a *Chlamydia* sp. CT443 polypeptide as described herein.

In some embodiments, the composition may comprise (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, and (c) a nucleic acid as described herein comprising a nucleotide sequence encoding a *Chlamydia* sp. CT584 polypeptide as described herein.

Typically, the composition may comprise (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, (c) a nucleic acid as described herein comprising a nucleotide sequence encoding a *Chlamydia* sp. CT443 polypeptide as described herein, and (d) a nucleic acid as described herein comprising a nucleotide sequence encoding a *Chlamydia* sp. CT584 polypeptide as described herein.

A composition of the present disclosure comprising one or more nucleic acids of the present disclosure can also include one or more additional components such as small molecule immunopotentiators (e.g., TLR agonists). A composition of the present disclosure can also include a delivery system for a nucleic acid described herein (e.g., RNA), such as a liposome, an oil-in-water emulsion, or a microparticle. In some embodiments, the composition comprises a lipid nanoparticle (LNP). In certain embodiments, the composition comprises a nucleic acid molecule of the invention encapsulated within an LNP.

Polypeptide Compositions

In one aspect the invention provides a composition comprising a modified MOMP polypeptide as described herein.

In another aspect, the invention provides a composition comprising a chimeric MOMP VD polypeptide as described herein.

In another aspect, the invention provides a composition comprising a *Chlamydia* sp. CT443 polypeptide as described herein.

In another aspect, the invention provides a composition comprising a *Chlamydia* sp. CT584 polypeptide as described herein.

In another aspect, the invention provides a composition comprising a *Chlamydia* sp. CT600 polypeptide as described herein.

In another aspect, the invention provides a composition comprising a *Chlamydia* sp. CT812 polypeptide as described herein.

In a further aspect, the invention provides a composition comprising one, two, three or four of: (a) a polypeptide comprising an amino acid sequence of a *Chlamydia* sp. CT443 polypeptide as described herein; (b) a polypeptide comprising an amino acid sequence of a *Chlamydia* sp. CT584 polypeptide as described herein; (c) a polypeptide comprising an amino acid sequence of a *Chlamydia* sp. CT600 polypeptide as described herein; and/or (d) a polypeptide comprising an amino acid sequence of a *Chlamydia* sp. CT812 polypeptide as described herein.

A composition of the invention may comprise a combination as described herein of the polypeptides as described herein (e.g., they may be formulated in the same composition). The combinations as described herein of the polypeptides as described herein may alternatively be in two or more separate compositions (e.g., as a combination of compositions for simultaneous, separate or sequential administration, (e.g., in a therapeutic use as described herein)).

In some embodiments, the composition may comprise (i) a modified MOMP polypeptide as described herein, (ii) a chimeric MOMP VD polypeptide as described herein, and (iii) a *Chlamydia* sp. CT443 polypeptide as described herein.

In some embodiments, the composition may comprise (i) a modified MOMP polypeptide as described herein, (ii) a chimeric MOMP VD polypeptide as described herein, and (iii) a *Chlamydia* sp. CT584 polypeptide as described herein.

Typically, the composition may comprise (i) a modified MOMP polypeptide as described herein, (ii) a chimeric MOMP VD polypeptide as described herein, (iii) a *Chlamydia* sp. CT443 polypeptide as described herein, and (iv) a *Chlamydia* sp. CT584 polypeptide as described herein.

A composition of the present disclosure comprising one or more polypeptides of the present disclosure may comprise an adjuvant. As used herein, an "adjuvant" refers to a substance or vehicle that enhances the immune response to an antigen. Adjuvants can include, without limitation, a suspension of minerals (e.g., alum, aluminum hydroxide, or phosphate) on which antigen is adsorbed; a water-in-oil or oil-in-water emulsion in which antigen solution is emulsified in mineral oil or in water (e.g., Freund's incomplete adjuvant). Sometimes killed mycobacteria is included (e.g., Freund's complete adjuvant) to further enhance antigenicity. Adjuvants can include squalene based oil in water emulsion adjuvants (e.g., AF03 e.g as described in WO2007006939 and U.S. Pat. No. 8,703,095; AS03, e.g., as described in WO1995017209, WO1995017210 and U.S. Pat. Nos. 6,623, 739, 7,029,678 and 7,510,698; and MF59, e.g as described in WO1990014837 and U.S. Pat. Nos. 6,299,884 and 6,451, 325). Immuno-stimulatory oligonucleotides (e.g., a CpG motif) can also be used as adjuvants (for example, see U.S. Pat. Nos. 6,194,388; 6,207,646; 6,214,806; 6,218,371; 6,239,116; 6,339,068; 6,406,705; and 6,429,199). Adjuvants can also include biological molecules, such as Toll-Like Receptor (TLR) agonists (e.g., AS01, e.g., as described in WO2007068907 and U.S. Pat. Nos. 10,039,823 and 10,143, 745; SPA14, e.g., as described in WO2022090359; and LEQ, e.g., as described in WO2023056089) and costimulatory molecules. In some embodiments, the adjuvant is AF03

(an oil-in-water squalene-based emulsion adjuvant). In some embodiments, the adjuvant is one that can elicit a Th1 response.

Nucleic Acid Combinations

The invention provides combinations comprising two or more nucleic acids of the invention.

Thus, in one aspect the invention provides a combination comprising a nucleic acid as described herein comprising a nucleotide sequence encoding a modified MOMP polypeptide as described herein and:
(i) a nucleic acid as described herein comprising a nucleotide sequence encoding a chimeric MOMP VD polypeptide as described herein; and/or
(ii) one or more of
  (a) a nucleic acid as described herein that comprises a nucleotide sequence encoding a *Chlamydia* sp. CT443 polypeptide as described herein;
  (b) a nucleic acid as described herein that comprises a nucleotide sequence encoding a *Chlamydia* sp. CT584 polypeptide as described herein;
  (c) a nucleic acid as described herein that comprises a nucleotide sequence encoding a *Chlamydia* sp. CT600 polypeptide as described herein; and/or
  (d) a nucleic acid as described herein that comprises a nucleotide sequence encoding a *Chlamydia* sp. CT812 polypeptide as described herein.

In some embodiments, the combination comprises the nucleic acid of (a), the nucleic acid of (b), the nucleic acid of (c), the nucleic acid of (d), the nucleic acids of (a) and (b), the nucleic acids of (a) and (c), the nucleic acids of (a) and (d), the nucleic acids of (b) and (c), the nucleic acids of (b) and (d), the nucleic acids of (c) and (d), the nucleic acids of (a), (b) and (c), the nucleic acids of (a), (c) and (d), the nucleic acids of (a), (b) and (d), the nucleic acids of (b), (c) and (d), or the nucleic acids of (a), (b), (c) and (d). In some embodiments, the combination comprises the nucleic acid of (a). In some embodiments, the combination comprises the nucleic acid of (b). Typically, the combination comprises the nucleic acid of (a) and the nucleic acid of (b).

The nucleic acids of any of (a)-(d) may be located on the same nucleic acid molecule. Alternatively, the nucleic acids of (a)-(d) may be separate nucleic acid molecules.

Thus, in some embodiments, a combination of the invention comprises a nucleic acid as described herein comprising a nucleotide sequence encoding a modified MOMP polypeptide as described herein and a nucleic acid as described herein comprising a nucleotide sequence encoding a chimeric MOMP VD polypeptide as described herein.

In some embodiments, a combination of the invention comprises a nucleic acid as described herein comprising a nucleotide sequence encoding a modified MOMP polypeptide as described herein and one, two, three or four of (a) a nucleic acid as described herein that comprises a nucleotide sequence encoding a *Chlamydia* sp. CT443 polypeptide as described herein; (b) a nucleic acid as described herein that comprises a nucleotide sequence encoding a *Chlamydia* sp. CT584 polypeptide as described herein; (c) a nucleic acid as described herein that comprises a nucleotide sequence encoding a *Chlamydia* sp. CT600 polypeptide as described herein; and/or (d) a nucleic acid as described herein that comprises a nucleotide sequence encoding a *Chlamydia* sp. CT812 polypeptide as described herein. The combination may comprise any of the (a)-(d) non-MOMP antigen combinations set out above. In some embodiments, the combination comprises the nucleic acid of (a). In some embodiments, the combination comprises the nucleic acid of (b). Typically, the combination comprises the nucleic acid of (a) and the nucleic acid of (b).

In some embodiments, a combination of the invention comprises (i) a nucleic acid as described herein comprising a nucleotide sequence encoding a modified MOMP polypeptide as described herein; (ii) a nucleic acid as described herein comprising a nucleotide sequence encoding a chimeric MOMP VD polypeptide as described herein; and (iii) one, two, three or four of the nucleic acids in (a)-(d). The combination may comprise any of the (a)-(d) non-MOMP antigen combinations set out above. In some embodiments, the combination comprises the nucleic acid of (a). In some embodiments, the combination comprises the nucleic acid of (b). Typically, the combination comprises the nucleic acid of (a) and the nucleic acid of (b).

In a further aspect, the invention provides a combination comprising a nucleic acid as described herein comprising a nucleotide sequence encoding a chimeric MOMP VD polypeptide as described herein and one, two, three or four of the nucleic acids in (a)-(d). The combination may comprise any of the (a)-(d) non-MOMP antigen combinations set out above. In some embodiments, the combination comprises the nucleic acid of (a). In some embodiments, the combination comprises the nucleic acid of (b). Typically, the combination comprises the nucleic acid of (a) and the nucleic acid of (b). In some embodiments, the combination further comprises a nucleic acid as described herein comprising a nucleotide sequence encoding a modified MOMP polypeptide as described herein.

In another aspect, the invention provides a combination comprising a nucleic acid as described herein that comprises a nucleotide sequence encoding a *Chlamydia* sp. CT443 polypeptide as described herein and one, two or three of the nucleic acids as defined in (b)-(d). The combination may comprise any of the non-MOMP antigen combinations of (b), (c) and/or (d) set out above. Typically, the combination comprises the nucleic acid of (b). In some embodiments, the combination further comprises a nucleic acid comprising a nucleotide sequence encoding a native *Chlamydia* sp. MOMP polypeptide or a variant thereof.

In another aspect, the invention provides a combination comprising a nucleic acid as described herein that comprises a nucleotide sequence encoding a *Chlamydia* sp. CT584 polypeptide as described herein and one, two or three of the nucleic acids as defined in (a), (c) or (d). The combination may comprise any of the non-MOMP antigen combinations of (a), (c) and/or (d) set out above. Typically, the combination comprises the nucleic acid of (a). In some embodiments, the combination further comprises a nucleic acid comprising a nucleotide sequence encoding a native *Chlamydia* sp. MOMP polypeptide or a variant thereof.

In another aspect, the invention provides a combination comprising a nucleic acid as described herein that comprises a nucleotide sequence encoding a *Chlamydia* sp. CT600 polypeptide as described herein and one, two or three of the nucleic acids as defined in (a), (b) or (d). The combination may comprise any of the non-MOMP antigen combinations of (a), (b) and/or (d) set out above. In some embodiments, the combination further comprises a nucleic acid comprising a nucleotide sequence encoding a native *Chlamydia* sp. MOMP polypeptide or a variant thereof.

In another aspect, the invention provides a combination comprising a nucleic acid as described herein that comprises a nucleotide sequence encoding a *Chlamydia* sp. CT812 polypeptide as described herein and one, two or three of the nucleic acids as defined in (a)-(c). The combination may comprise any of the non-MOMP antigen combinations of (a), (b) and/or (c) set out above. In some embodiments, the combination further comprises a nucleic acid comprising a nucleotide sequence encoding a native *Chlamydia* sp. MOMP polypeptide or a variant thereof.

Thus, the combination of the invention may comprise a nucleic acid comprising a nucleotide sequence encoding a native *Chlamydia* sp. MOMP polypeptide, or a variant thereof, and one, two, three or four of the nucleic acids in (a)-(d). Variants of a native *Chlamydia* sp. MOMP polypeptide include MOMP polypeptides comprising one or more conservative amino acid substitutions, MOMP polypeptides comprising a single amino acid substitution at one or more (e.g., all) positions corresponding to a cysteine residue in a native *Chlamydia* sp. MOMP polypeptide and MOMP polypeptides comprising a single amino acid substitution at one or more (e.g., all) positions corresponding to a glycosylation site, e.g., an N-glycosylation site, in a native *Chlamydia* sp. MOMP polypeptide. Variants of a native *Chlamydia* sp. MOMP polypeptide also include MOMP polypeptides that comprise a secretion signal peptide sequence and MOMP polypeptides comprising a heterologous transmembrane domain. In some embodiments, a variant of a native *Chlamydia* sp. MOMP polypeptide comprises a secretion signal peptide sequence. In some embodiments, a variant of a native *Chlamydia* sp. MOMP polypeptide comprises a secretion signal peptide sequence and a heterologous transmembrane domain.

The combinations of the nucleic acids as disclosed herein encompass all of the individual nucleic acids being in the same composition and all of the individual nucleic acids being in one or more separate compositions. In some embodiments, all of the individual nucleic acids in a combination as described herein are in the same composition. In some embodiments, each of the nucleic acids in a combination as described herein is a separate composition. In some embodiments, two or more of the nucleic acids in a combination as described herein are in two or more compositions. In some embodiments of the combinations of the invention, the one, two, three or four of the nucleic acids of (a)-(d) above are in one or more compositions.

In some embodiments of the combinations of the invention, the two, three or four of the nucleic acids of (a)-(d) above are in two or more separate compositions. Typically, all of the individual nucleic acids are in the same composition.

Polypeptide Combinations

The invention provides combinations comprising two or more polypeptides of the invention.

Thus, in one aspect, the invention provides a combination comprising a modified MOMP polypeptide as described herein and:

(i) a chimeric MOMP VD polypeptide as described herein; and/or (ii) one or more of (a) a polypeptide comprising an amino acid sequence of a *Chlamydia* sp. CT443 polypeptide as described herein;

(b) a polypeptide comprising an amino acid sequence of a *Chlamydia* sp. CT584 polypeptide as described herein:

(c) a polypeptide comprising amino acid sequence of a *Chlamydia* sp. CT600 polypeptide as described herein; and/or (d) a polypeptide comprising amino acid sequence of a *Chlamydia* sp. CT812 polypeptide as described herein.

In some embodiments, the combination comprises the polypeptide of (a), the polypeptide of (b), the polypeptide of (c), the polypeptide of (d), the polypeptides of (a) and (b), the polypeptides of (a) and (c), the polypeptides of (a) and (d), the polypeptides of (b) and (c), the polypeptides of (b) and (d), the polypeptides of (c) and (d), the polypeptides of (a), (b) and (c), the polypeptides of (a), (c) and (d), the polypeptides of (a), (b) and (d), the polypeptides of (b), (c) and (d), the polypeptides of (a), (b), (c) and (d). In some embodiments, the combination comprises the polypeptide of (a). In some embodiments, the combination comprises the polypeptide of (b). Typically, the combination comprises the polypeptide of (a) and the polypeptide of (b).

Thus, in some embodiments, a combination of the invention comprises a modified MOMP polypeptide as described herein and a chimeric MOMP VD polypeptide as described herein.

In some embodiments, a combination of the invention comprises a modified MOMP polypeptide as described herein and one, two, three or four of (a) a polypeptide comprising an amino acid sequence of a *Chlamydia* sp. CT443 polypeptide as described herein; (b) a polypeptide comprising an amino acid sequence of a *Chlamydia* sp. CT584 polypeptide as described herein; (c) a polypeptide comprising an amino acid sequence of a *Chlamydia* sp. CT600 polypeptide as described herein; and/or (d) a polypeptide comprising an amino acid sequence of a *Chlamydia* sp. CT812 polypeptide as described herein. The combination may comprise any of the (a)-(d) non-MOMP antigen combinations set out above. In some embodiments, the combination comprises the polypeptide of (a). In some embodiments, the combination comprises the polypeptide of (b). Typically, the combination comprises the polypeptide of (a) and the polypeptide of (b).

In some embodiments, a combination of the invention comprises (i) a modified MOMP polypeptide as described herein; (ii) a chimeric MOMP VD polypeptide as described herein and (iii) one, two, three or four of the polypeptides in (a)-(d). The combination may comprise any of the (a)-(d) non-MOMP antigen combinations set out above. In some embodiments, the combination comprises the polypeptide of (a). In some embodiments, the combination comprises the polypeptide of (b). Typically, the combination comprises the polypeptide of (a) and the polypeptide of (b).

In a further aspect, the invention provides a combination comprising a chimeric MOMP VD polypeptide as described herein and one, two, three or four of the polypeptides in (a)-(d). The combination may comprise any of the (a)-(d) non-MOMP antigen combinations set out above. In some embodiments, the combination comprises the polypeptide of (a). In some embodiments, the combination comprises the polypeptide of (b). Typically, the combination comprises the polypeptide of (a) and the polypeptide of (b). In some embodiments, the composition further comprises a modified MOMP polypeptide as described herein.

In another aspect, the invention provides a combination comprising a polypeptide comprising an amino acid sequence of a *Chlamydia* sp. CT443 polypeptide as described herein and one, two or three of the polypeptides as defined in (b)-(d). The combination may comprise any of the non-MOMP antigen combinations of (b), (c) and/or (d) set out above. Typically, the combination comprises the polypeptide of (b). In some embodiments, the combination further comprises a native *Chlamydia* sp. MOMP polypeptide or a variant thereof.

In another aspect, the invention provides a combination comprising a polypeptide comprising an amino acid sequence of a *Chlamydia* sp. CT584 polypeptide as described herein and one, two or three of the polypeptides as defined in (a), (c) or (d). The combination may comprise any of the non-MOMP antigen combinations of (a), (c) and/or (d) set out above. Typically, the combination comprises the polypeptide of (a). In some embodiments, the combination further comprises a native *Chlamydia* sp. MOMP polypeptide or a variant thereof.

In another aspect, the invention provides a combination comprising a polypeptide comprising an amino acid sequence of a *Chlamydia* sp. CT600 polypeptide as described herein and one, two or three of the polypeptides as defined in (a), (b) or (d). The combination may comprise any of the non-MOMP antigen combinations of (a), (b) and/or (d) set out above. In some embodiments, the combination further comprises a native *Chlamydia* sp. MOMP polypeptide or a variant thereof.

In another aspect, the invention provides a combination comprising a polypeptide comprising an amino acid sequence of a *Chlamydia* sp. CT812 polypeptide as described herein and one, two or three of the polypeptides as defined in (a)-(c). The combination may comprise any of the non-MOMP antigen combinations of (a), (b) and/or (c) set out above. In some embodiments, the combination further comprises a native *Chlamydia* sp. MOMP polypeptide or a variant thereof.

Thus, a combination of the invention may comprise a native *Chlamydia* sp. MOMP polypeptide, or a variant thereof, and one, two, three or four of the polypeptides in (a)-(d). Variants of a native *Chlamydia* sp. MOMP polypeptide include MOMP polypeptides comprising one or more conservative amino acid substitutions, MOMP polypeptides comprising a single amino acid substitution at one or more (e.g., all) positions corresponding to a cysteine residue in a native *Chlamydia* sp. MOMP polypeptide and MOMP polypeptides comprising a single amino acid substitution at one or more (e.g., all) positions corresponding to a glycosylation site, e.g., an N-glycosylation site, in a native *Chlamydia* sp. MOMP polypeptide. Variants of a native *Chlamydia* sp. MOMP polypeptide also include MOMP polypeptides that comprise a secretion signal peptide sequence and MOMP polypeptides comprising a heterologous transmembrane domain. In some embodiments, a variant of a native *Chlamydia* sp. MOMP polypeptide comprises a secretion signal peptide sequence. In some embodiments, a variant of a native *Chlamydia* sp. MOMP polypeptide comprises a secretion signal peptide sequence and a heterologous transmembrane domain.

The combinations of the polypeptides as disclosed herein encompass all of the individual polypeptides being in the same composition and all of the individual polypeptides being in one or more separate compositions. In some embodiments, all of the individual polypeptides in a combination described herein are in the same composition. In some embodiments, each of the polypeptides in a combination as described herein is in a separate composition. In some embodiments, two or more of the polypeptides in a combination as described herein are in two or more compositions. In some embodiments of the combinations of the invention, the one, two, three or four of the polypeptides of (a)-(d) above are in one or more compositions. In some embodiments of the combinations of the invention, the two, three or four of the polypeptides of (a)-(d) above are in two or more separate compositions. Typically, all of the individual polypeptides are in the same composition.

LNPs

In certain embodiments, the composition of the invention (e.g., the composition comprising a nucleic acid of the invention) further comprises a lipid nanoparticle (LNP). In certain embodiments, the nucleic acid of the invention is encapsulated in the LNP.

The LNPs of the disclosure may comprise four categories of lipids: (i) an ionizable lipid (e.g., a cationic lipid); (ii) a PEGylated lipid; (iii) a cholesterol-based lipid, and (iv) a helper lipid.

A. Ionizable Lipids

An ionizable lipid facilitates mRNA encapsulation and may be a cationic lipid. A cationic lipid affords a positively charged environment at low pH to facilitate efficient encapsulation of the negatively charged mRNA drug substance.

In some embodiments, the cationic lipid is OF-02:
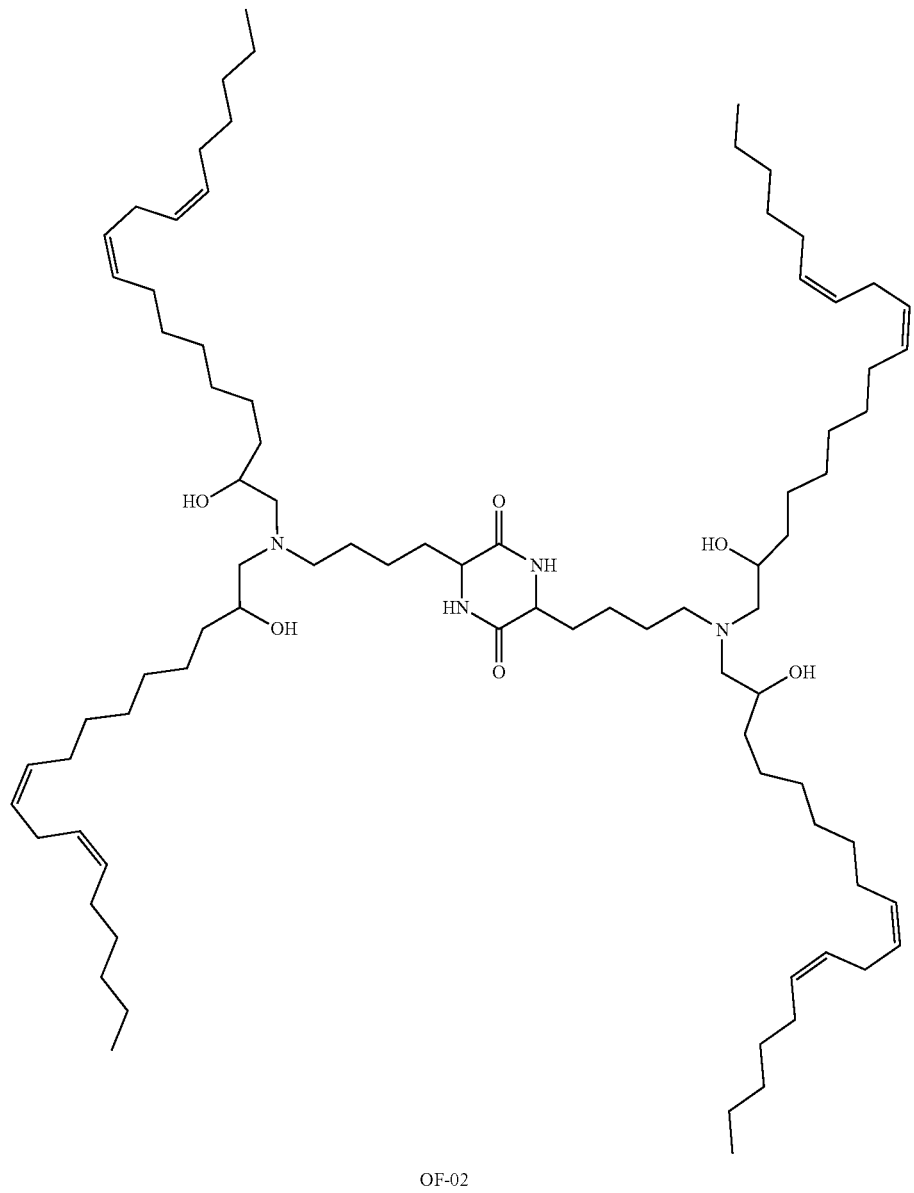
OF-02

OF-02 is a non-degradable structural analog of OF-Deg-Lin. OF-Deg-Lin contains degradable ester linkages to attach the diketopiperazine core and the doubly-unsaturated tails, whereas OF-02 contains non-degradable 1,2-amino-alcohol linkages to attach the same diketopiperazine core and the doubly-unsaturated tails (Fenton et al., *Adv Mater.* (2016) 28:2939; U.S. Pat. No. 10,201,618). An exemplary LNP formulation herein, Lipid A, contains OF-02.

In some embodiments, the cationic lipid is cKK-E10 (Dong et al., PNAS (2014) 111(111):3955-60; U.S. Pat. No. 9,512,073):

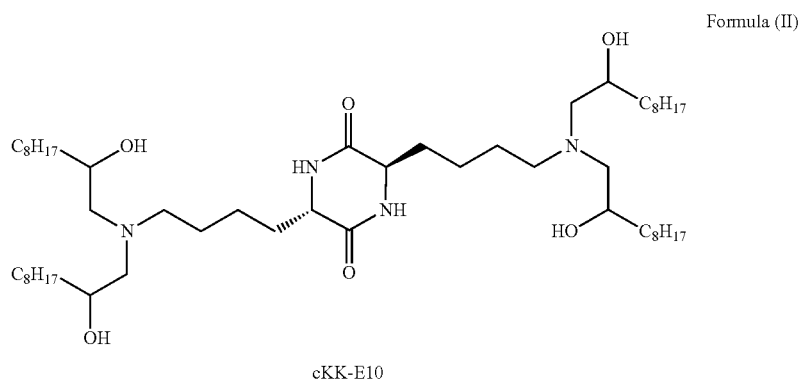

Formula (II)

cKK-E10

An exemplary LNP formulation herein, Lipid B, contains cKK-E10.

In some embodiments, the cationic lipid is GL-HEPES-E3-E10-DS-3-E18-1 (2-(4-(2-((3-(Bis((Z)-2-hydroxyocta-dec-9-en-1-yl)amino)propyl)disulfaneyl)ethyl)piperazin-1-yl)ethyl 4-(bis(2-hydroxydecyl)amino)butanoate), which is a HEPES-based disulfide cationic lipid with a piperazine core, having the Formula III:

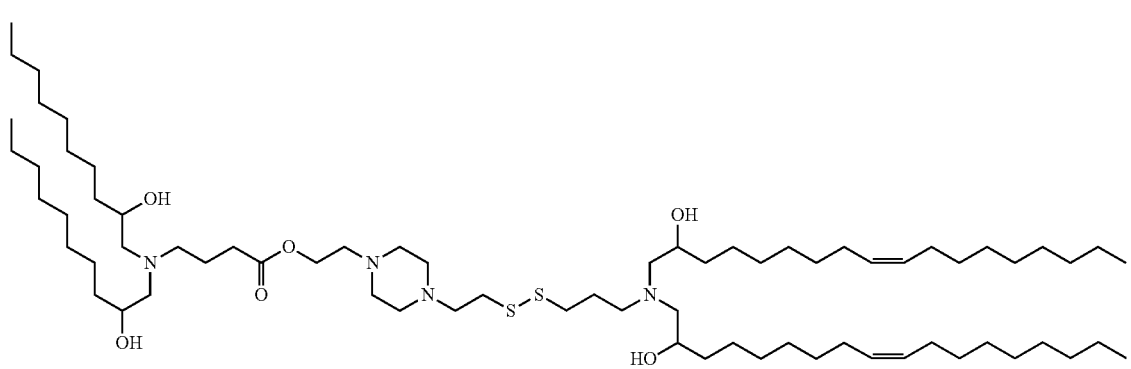

Formula (III)

An exemplary LNP formulation herein, Lipid C, contains GL-HEPES-E3-E10-DS-3-E18-1. Lipid C has the same composition as Lipid A or Lipid B but for the difference in the cationic lipid.

In some embodiments, the cationic lipid is GL-HEPES-E3-E12-DS-4-E10 (2-(4-(2-((3-(bis(2-hydroxydecyl)amino)butyl)disulfaneyl)ethyl)piperazin-1-yl)ethyl 4-(bis(2-hydroxydodecyl)amino)butanoate), which is a HEPES-based disulfide cationic lipid with a piperazine core, having the Formula IV:

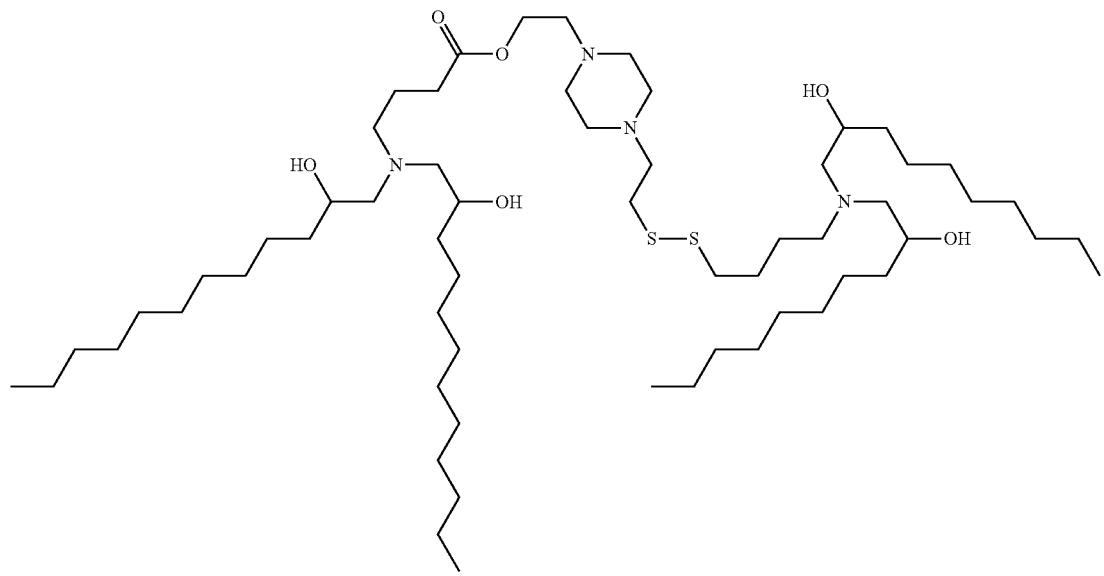

Formula (IV)

An exemplary LNP formulation herein, Lipid D, contains GL-HEPES-E3-E12-DS-4-E10. Lipid D has the same composition as Lipid A or Lipid B but for the difference in the cationic lipid.

In some embodiments, the cationic lipid is GL-HEPES-E3-E12-DS-3-E14 (2-(4-(2-((3-(Bis(2-hydroxytetradecyl)amino)propyl)disulfaneyl)ethyl)piperazin-1-yl)ethyl 4-(bis(2-hydroxydodecyl)amino)butanoate), which is a HEPES-based disulfide cationic lipid with a piperazine core, having the Formula V:

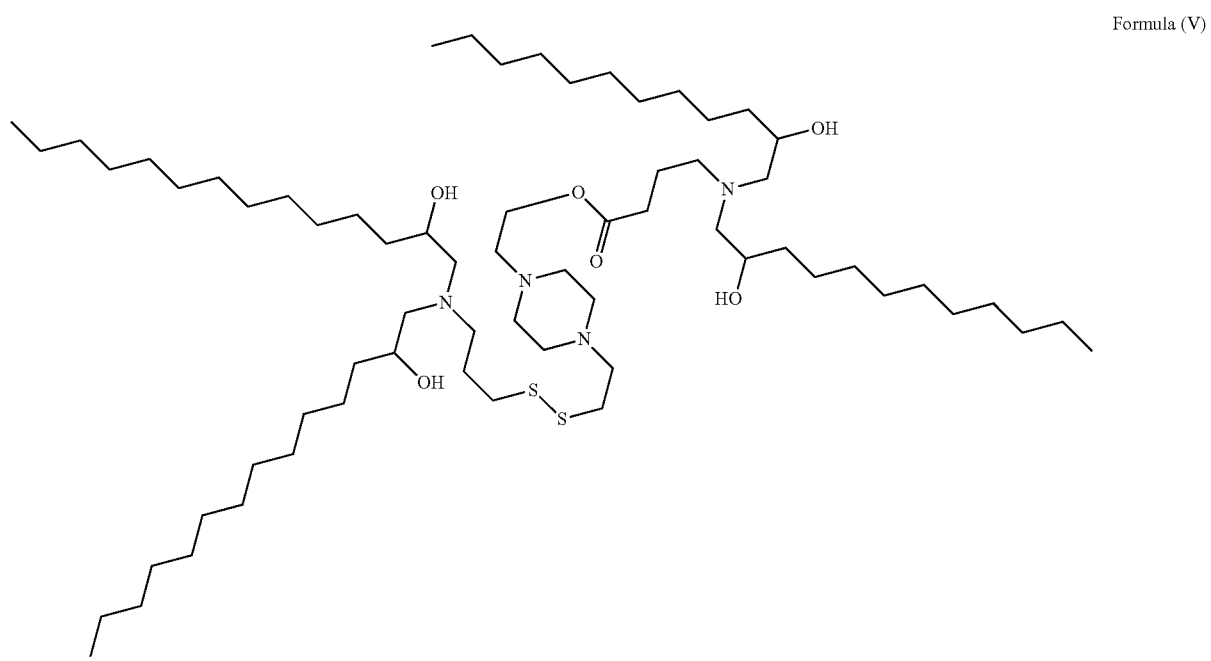 [SMILES: CCCCCCCCCCCCC(O)CN(CCCSSCCN1CCN(CCOC(=O)CCCN(CC(O)CCCCCCCCCC)CC(O)CCCCCCCCCC)CC1)CC(O)CCCCCCCCCCCC]

Formula (V)

An exemplary LNP formulation herein, Lipid E, contains GL-HEPES-E3-E12-DS-3-E14. Lipid E has the same composition as Lipid A or Lipid B but for the difference in the cationic lipid.
The cationic lipids GL-HEPES-E3-E10-DS-3-E18-1 (III), GL-HEPES-E3-E12-DS-4-E10 (IV), and GL-HEPES-E3-E12-DS-3-E14 (V) can be synthesized according to the general procedure set out in Scheme 1:
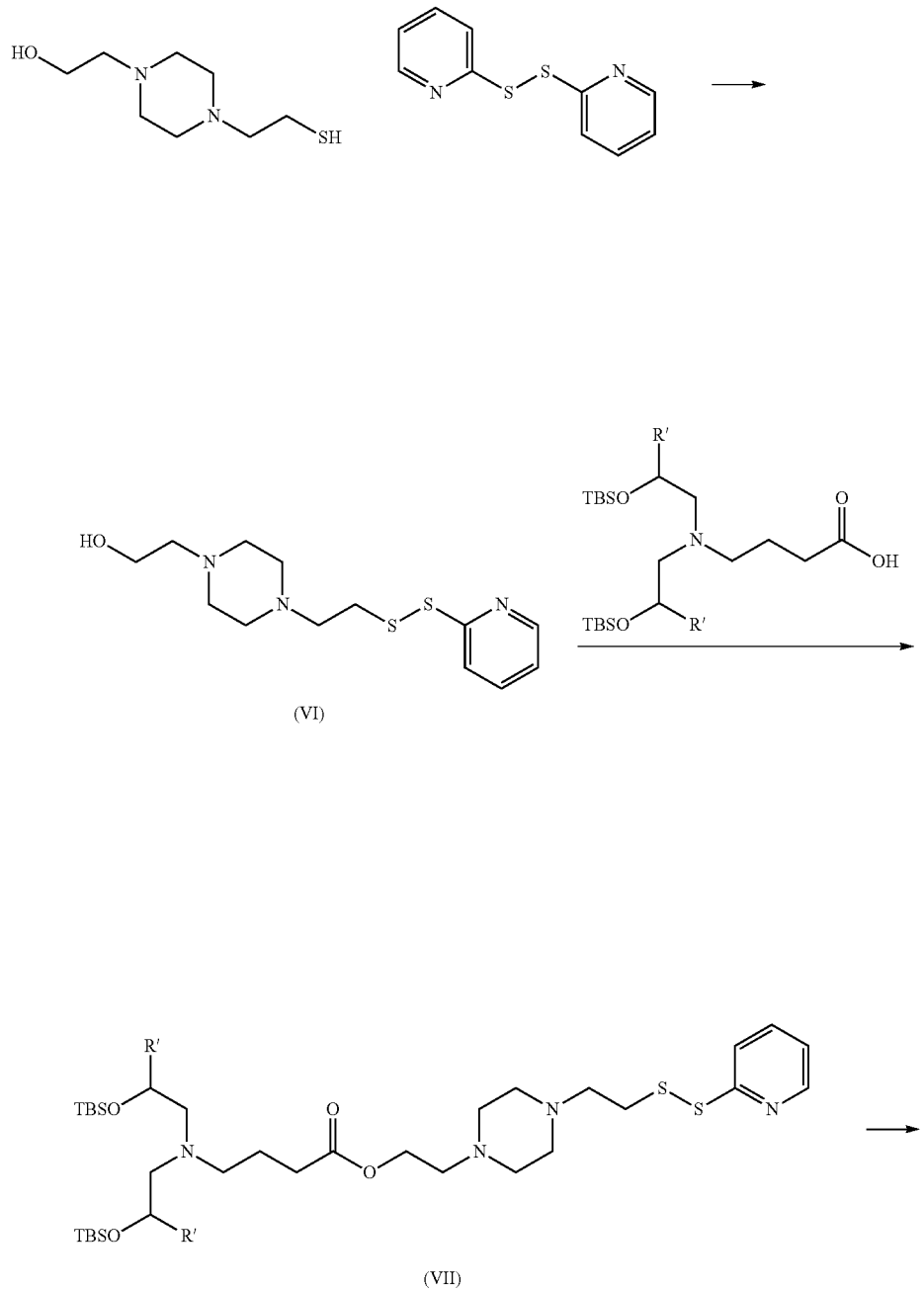

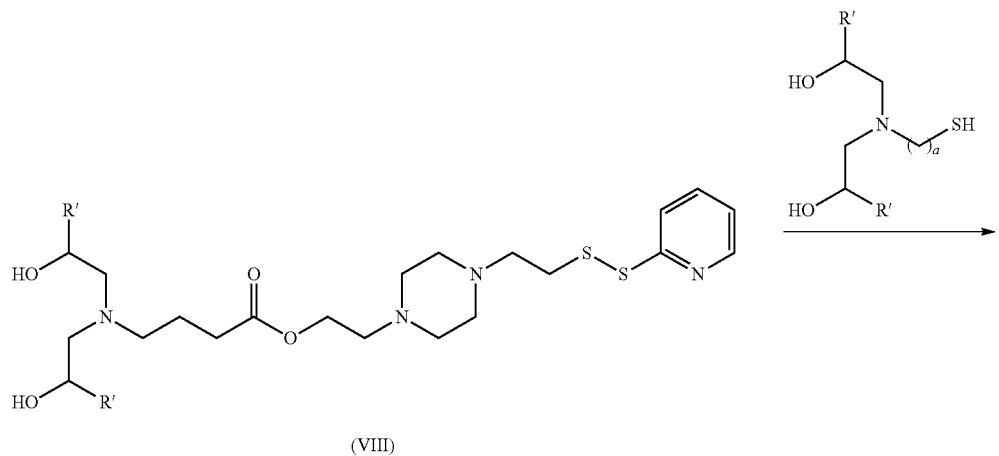
(VIII)
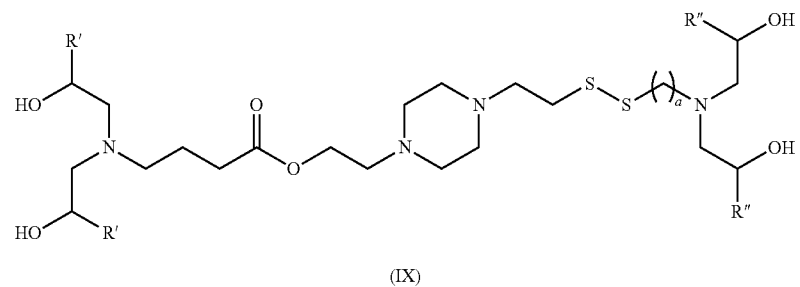
(IX)
In some embodiments, the cationic lipid is MC3, having the Formula VI:
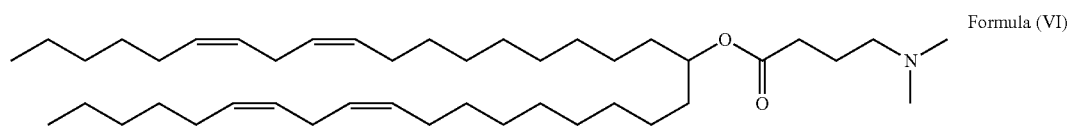
Formula (VI)

In some embodiments, the cationic lipid is SM-102 (9-heptadecanyl 8-{(2-hydroxyethyl)[6-oxo-6-(undecyloxy)hexyl]amino}octanoate), having the Formula VII:

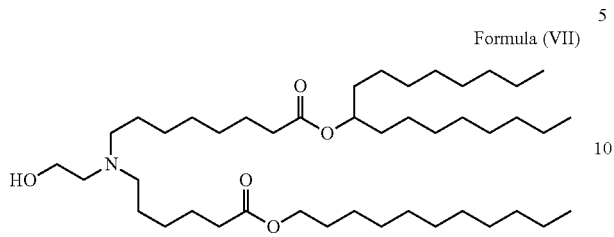

Formula (VII)

In some embodiments, the cationic lipid is ALC-0315 [(4-hydroxybutyl)azanediyl]di(hexane-6,1-diyl) bis(2-hexyldecanoate), having the Formula VIII:

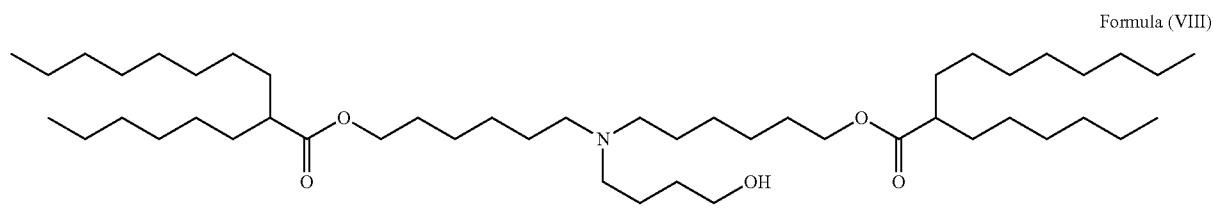 [SMILES: CCCCCCCCC(CCCCCC)C(=O)OCCCCCCN(CCCCO)CCCCCCOC(=O)C(CCCCCC)CCCCCCCC]

Formula (VIII)

In some embodiments, the cationic lipid is cOrn-EE1, having the Formula IX:

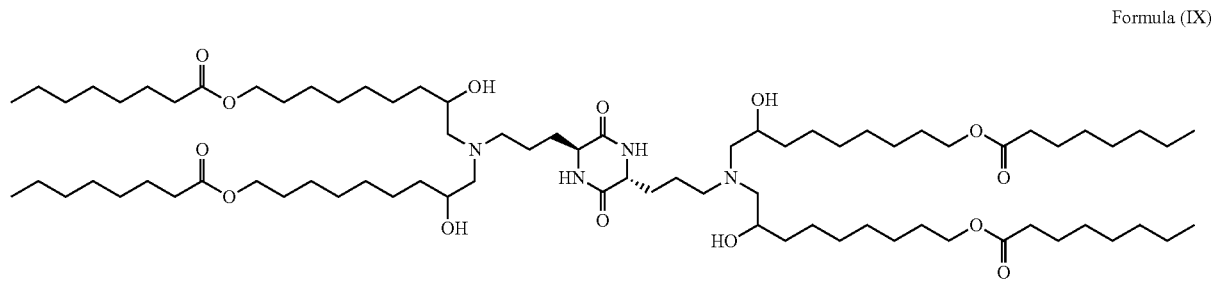 [SMILES: CCCCCCCC(=O)OCCCCCCCC(O)CN(CCC[C@@H]1NC(=O)[C@@H](CCCN(CC(O)CCCCCCCOC(=O)CCCCCCC)CC(O)CCCCCCCOC(=O)CCCCCCC)NC1=O)CC(O)CCCCCCCOC(=O)CCCCCCC]

Formula (IX)

In some embodiments, the cationic lipid is ATX-126 (4,4'-[[[[3-(dimethylamino)propyl]thio]carbonyl]imino]bis-butanoic acid, 1,1'-bis(1-heptyloctyl) ester), having the Formula X:

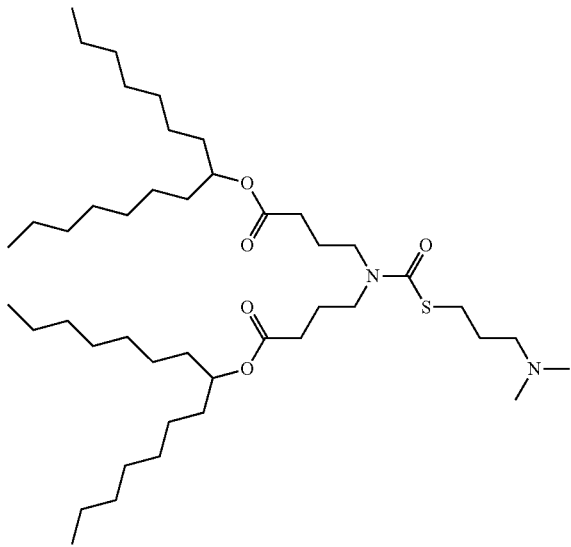 [SMILES: CCCCCCCC(CCCCCCC)OC(=O)CCCN(CCCC(=O)OC(CCCCCCC)CCCCCCC)C(=O)SCCCN(C)C]

In some embodiments, the cationic lipid may be selected from the group comprising cKK-E10; OF-02; [(6Z,9Z,28Z, 31Z)-heptatriaconta-6,9,28,31-tetraen-19-yl]4-(dimethylamino)butanoate (D-Lin-MC3-DMA); 2,2-dilinoleyl-4-dimethylaminoethyl-[1,3]-dioxolane (DLin-KC2-DMA); 1,2-dilinoleyloxy-N,N-dimethyl-3-aminopropane (Dlin-DMA); di((Z)-non-2-en-1-yl) 9-((4-(dimethylamino)butanoyl)oxy) heptadecanedioate (L319); 9-heptadecanyl 8-{(2-hydroxyethyl)[6-oxo-6-(undecyloxy)hexyl]amino}octanoate (SM-102); [(4-hydroxybutyl)azanediyl]di(hexane-6,1-diyl) bis(2-hexyldecanoate) (ALC-0315); [3-(dimethylamino)-2-[(Z)-octadec-9-enoyl]oxypropyl](Z)-octadec-9-enoate (DODAP); 2,5-bis(3-aminopropylamino)-N-[2-[di(heptadecyl)amino]-2-oxoethyl]pentanamide (DOGS); [(3S,8S, 9S,10R,13R,14S,17R)-10,13-dimethyl-17-[(2R)-6-methylheptan-2-yl]-2,3,4,7,8,9,11,12,14,15,16,17-dodecahydro-1H-cyclopenta[a]phenanthren-3-yl]N-[2-(dimethylamino) ethyl]carbamate (DC-Chol); tetrakis(8-methylnonyl) 3,3',3'', 3'''-(((methylazanediyl) bis(propane-3,1 diyl))bis (azanetriyl))tetrapropionate (306Oi10); decyl (2-(dioctylammonio)ethyl) phosphate (9A1P9); ethyl 5,5-di((Z)-heptadec-8-en-1-yl)-1-(3-(pyrrolidin-1-yl)propyl)-2,5-dihydro-1H-imidazole-2-carboxylate (A2-Iso5-2DC18); bis(2-(dodecyldisulfanyl)ethyl) 3,3'-((3-methyl-9-oxo-10-oxa-13, 14-dithia-3,6-diazahexacosyl)azanediyl)dipropionate (BAME-O16B); 1,1'-((2-(4-(2-((2-(bis(2-hydroxydodecyl) amino)ethyl) (2-hydroxydodecyl)amino)ethyl) piperazin-1-yl)ethyl)azanediyl) bis(dodecan-2-ol) (C12-200); 3,6-bis(4-(bis(2-hydroxydodecyl)amino)butyl)piperazine-2,5-dione (cKK-E12); hexa(octan-3-yl) 9,9',9'',9''',9'''',9'''''-((((benzene-1,3,5-tricarbonyl)tris(azanediyl)) tris (propane-3,1-diyl)) tris(azanetriyl))hexanonanoate (FTT5); (((3,6-di-oxopiperazine-2,5-diyl)bis(butane-4, 1-diyl))bis (azanetriyl))tetrakis(ethane-2,1-diyl) (9Z,9'Z,9''Z,9'''Z,12Z, 12'Z,12''Z,12'''Z)-tetrakis (octadeca-9,12-dienoate) (OF-Deg-Lin); TT3; $N^1,N^3,N^5$-tris(3-(didodecylamino)propyl) benzene-1,3,5-tricarboxamide; N1-[2-((1S)-1-[(3-aminopropyl)amino]-4-[di(3-aminopropyl)amino] butylcarboxamido)ethyl]-3,4-di[oleyloxy]-benzamide (MVL5); heptadecan-9-yl 8-((2-hydroxyethyl)(8-(nonyloxy)-8-oxooctyl)amino)octanoate (Lipid 5); 4,4'-[[[[3-(dimethylamino)propyl]thio]carbonyl]imino]bis-butanoic acid, 1,1'-bis(1-heptyloctyl) ester (ATX-126) GL-HEPES-E3-E10-DS-3-E18-1; GL-HEPES-E3-E12-DS-4-E10; GL-HEPES-E3-E12-DS-3-E14, IM-001; and combinations thereof.

In some embodiments, the cationic lipid is IM-001, having the Formula XI (EP23306049.0):

Formula (XI)

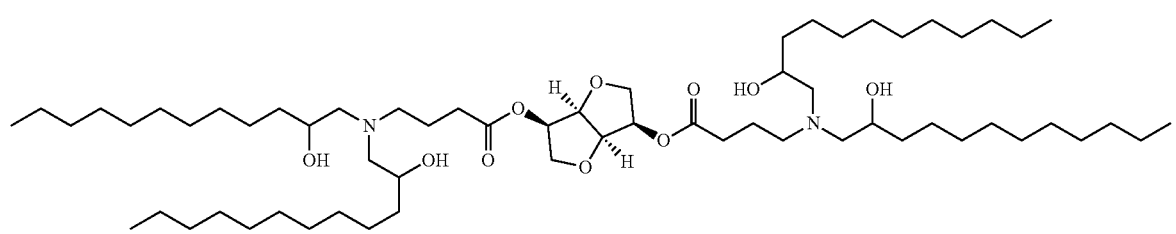

An exemplary LNP formulation herein, Lipid G, contains IM-001. Lipid G has the same composition as Lipid A or Lipid B but for the difference in the cationic lipid.

The cationic lipid IM-001 (XI) can be synthesized according to the general procedure set out in Scheme 2:

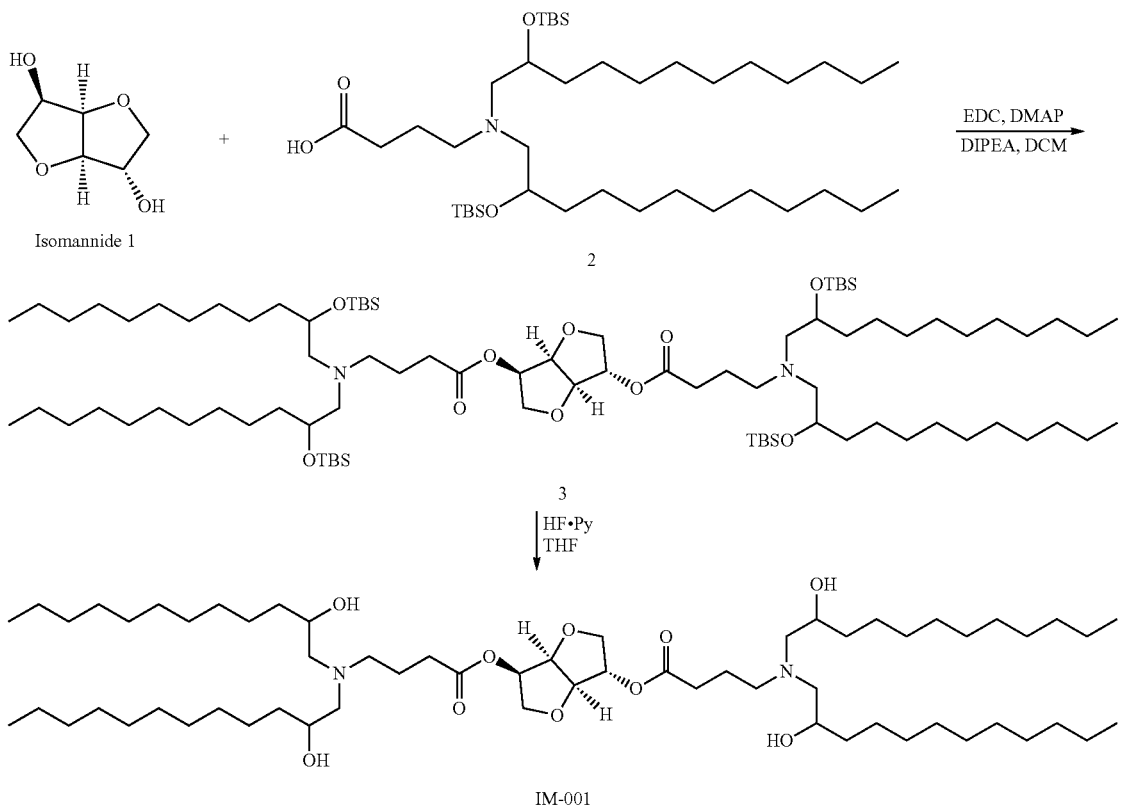

Scheme 2 may be performed as described in Example 14.

In some embodiments, the cationic lipid is biodegradable.

In some embodiments, the cationic lipid is not biodegradable.

In some embodiments, the cationic lipid is cleavable.

In some embodiments, the cationic lipid is not cleavable.

Cationic lipids are described in further detail in Dong et al. (PNAS. 111(11):3955-60. 2014); Fenton et al. (Adv Mater. 28:2939. 2016); U.S. Pat. Nos. 9,512,073; and 10,201,618, each of which is incorporated herein by reference.

B. PEGylated Lipids

The PEGylated lipid component provides control over particle size and stability of the nanoparticle. The addition of such components may prevent complex aggregation and provide a means for increasing circulation lifetime and increasing the delivery of the lipid-nucleic acid pharmaceutical composition to target tissues (Klibanov et al. FEBS Letters 268(1):235-7. 1990). These components may be selected to rapidly exchange out of the pharmaceutical composition in vivo (see, e.g., U.S. Pat. No. 5,885,613).

Contemplated PEGylated lipids include, but are not limited to, a polyethylene glycol (PEG) chain of up to 5 kDa in length covalently attached to a lipid with alkyl chain(s) of $C_6$-$C_{20}$ (e.g., $C_8$, $C_{10}$, $C_{12}$, $C_{14}$, $C_{16}$, or $C_{18}$) length, such as a derivatized ceramide (e.g., N-octanoyl-sphingosine-1-[succinyl(methoxypolyethylene glycol)](C8 PEG ceramide)). In some embodiments, the PEGylated lipid is 1,2-dimyristoyl-rac-glycero-3-methoxypolyethylene glycol (DMG-PEG); 1,2-distearoyl-sn-glycero-3-phosphoethanolamine-polyethylene glycol (DSPE-PEG); 1,2-dilauroyl-sn-glycero-3-phosphoethanolamine-polyethylene glycol (DLPE-PEG); or 1,2-distearoyl-rac-glycero-polyethelene glycol (DSG-PEG), PEG-DAG; PEG-PE; PEG-S-DAG; PEG-S-DMG; PEG-cer; a PEG-dialkyoxypropylcarbamate; 2-[(polyethylene glycol)-2000]-N,N-ditetradecylacetamide (ALC-0159); and combinations thereof.

In certain embodiments, the PEG has a high molecular weight, e.g., 2000-2400 g/mol. In certain embodiments, the PEG is PEG2000 (or PEG-2K). In certain embodiments, the PEGylated lipid herein is DMG-PEG2000, DSPE-PEG2000, DLPE-PEG2000, DSG-PEG2000, C8 PEG2000, or ALC-0159 (2-[(polyethylene glycol)-2000]-N,N-ditetradecylacetamide). In certain embodiments, the PEGylated lipid herein is DMG-PEG2000.

C. Cholesterol-Based Lipids

The cholesterol component provides stability to the lipid bilayer structure within the nanoparticle. In some embodiments, the LNPs comprise one or more cholesterol-based lipids. Suitable cholesterol-based lipids include, for example: DC-Choi (N,N-dimethyl-N-ethylcarboxamido-cholesterol), 1,4-bis(3-N-oleylamino-propyl)piperazine (Gao et al., *Biochem Biophys Res Comm.* (1991) 179:280; Wolf et al., *BioTechniques* (1997) 23:139; U.S. Pat. No. 5,744,335), imidazole cholesterol ester ("ICE"; WO2011/068810), sitosterol (22,23-dihydrostigmasterol), 3-sitosterol, sitostanol, fucosterol, stigmasterol (stigmasta-5,22-dien-3-ol), ergosterol; desmosterol (36-hydroxy-5,24-cholestadiene); lanosterol (8,24-lanostadien-3b-ol); 7-dehydrocholesterol (Δ5,7-cholesterol); dihydrolanosterol (24,25-dihydrolanosterol); zymosterol (5α-cholesta-8,24-dien-3ß-ol); lathosterol (5α-cholest-7-en-3ß-ol); diosgenin ((3β,25R)-spirost-5-en-3-ol); campesterol (campest-5-en-3ß-ol); campestanol (5α-campestan-3b-ol); 24-methylene cholesterol (5,24(28)-cholestadien-24-methylen-3ß-ol); cholesteryl margarate (cholest-5-en-3M-yl heptadecanoate); cholesteryl oleate; cholesteryl stearate and other modified forms of cholesterol. In some embodiments, the cholesterol-based lipid used in the LNPs is cholesterol.

D. Helper Lipids

A helper lipid enhances the structural stability of the LNP and helps the LNP in endosome escape. It improves uptake and release of the mRNA drug payload. In some embodiments, the helper lipid is a zwitterionic lipid, which has fusogenic properties for enhancing uptake and release of the drug payload. Examples of helper lipids are 1,2-dioleoyl-SN-glycero-3-phosphoethanolamine (DOPE); 1,2-distearoyl-sn-glycero-3-phosphocholine (DSPC); 1,2-dioleoyl-sn-glycero-3-phospho-L-serine (DOPS); 1,2-dielaidoyl-sn-glycero-3-phosphoethanolamine (DEPE); and 1,2-dioleoyl-sn-glycero-3-phosphocholine (DPOC), dipalmitoylphosphatidylcholine (DPPC), DMPC, 1,2-dilauroyl-sn-glycero-3-phosphocholine (DLPC), 1,2-Distearoylphosphatidylethanolamine (DSPE), and 1,2-dilauroyl-sn-glycero-3-phosphoethanolamine (DLPE).

Other exemplary helper lipids are dioleoylphosphatidylcholine (DOPC), dioleoylphosphatidylglycerol (DOPG), dipalmitoylphosphatidylglycerol (DPPG), palmitoyloleoylphosphatidylcholine (POPC), palmitoyloleoyl-phosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), phosphatidylserine, sphingolipids, sphingomyelins, ceramides, cerebrosides, gangliosides, 16-O-monomethyl PE, 16-O-dimethyl PE, 18-1-trans PE, 1-stearoyl-2-oleoyl-phosphatidylethanolamine (SOPE), or a combination thereof. In certain embodiments, the helper lipid is DOPE. In certain embodiments, the helper lipid is DSPC.

In various embodiments, the present LNPs comprise (i) a cationic lipid selected from OF-02, cKK-E10, GL-HEPES-E3-E10-DS-3-E18-1, GL-HEPES-E3-E12-DS-4-E10, GL-HEPES-E3-E12-DS-3-E14, or IM-001; (ii) DMG-PEG2000; (iii) cholesterol; and (iv) DOPE.

In other embodiments, the present LNPs comprise (i) SM-102, (ii) DMG-PEG2000, (iii) cholesterol, and (iv) DSPC.

In yet other embodiments, the present LNPs comprise (i) ALC-0315, (ii) ALC-0159, (iii) cholesterol, and (iv) DSPC.

In yet other embodiments, the present LNPs comprise (i) ATX-126, (ii) DMG-PEG2000, (iii) cholesterol, and (iv) DSPC.

E. Molar Ratios of the Lipid Components

The molar ratios of the above components are important for the LNPs' effectiveness in delivering mRNA. The molar ratio of the cationic lipid, the PEGylated lipid, the cholesterol-based lipid, and the helper lipid is A:B:C:D, where A+B+C+D=100%. In some embodiments, the molar ratio of the cationic lipid in the LNPs relative to the total lipids (i.e., A) is 35-55%, such as 35-50% (e.g., 38-42% such as 40%, or 45-50%). In some embodiments, the molar ratio of the PEGylated lipid component relative to the total lipids (i.e., B) is 0.25-2.75% (e.g., 1-2% such as 1.5%). In some embodiments, the molar ratio of the cholesterol-based lipid relative to the total lipids (i.e., C) is 20-50% (e.g., 27-30% such as 28.5%, or 38-43%). In some embodiments, the molar ratio of the helper lipid relative to the total lipids (i.e., D) is 5-35% (e.g., 28-32% such as 30%, or 8-12%, such as 10%). In some embodiments, the (PEGylated lipid+cholesterol) components have the same molar amount as the helper lipid. In some embodiments, the LNPs contain a molar ratio of the cationic lipid to the helper lipid that is more than 1.

In certain embodiments, the LNP of the disclosure comprises:
 a cationic lipid at a molar ratio of 35% to 55% or 40% to 50% (e.g., a cationic lipid at a molar ratio of 35%, 36%, 37%, 38%, 39%, 40%, 41% 42%, 43%, 44%, 45%, 46%, 47%, 48%, 49%, 50%, 51%, 52%, 53%, 54%, or 55%);
 a polyethylene glycol (PEG) conjugated (PEGylated) lipid at a molar ratio of 0.25% to 2.75% or 1.00% to 2.00% (e.g., a PEGylated lipid at a molar ratio of 0.25%, 0.50%, 0.75%, 1.00%, 1.25%, 1.50%, 1.75%, 2.00%, 2.25%, 2.50%, or 2.75%);
 a cholesterol-based lipid at a molar ratio of 20% to 50%, 25% to 45%, or 28.5% to 43% (e.g., a cholesterol-based lipid at a molar ratio of 20%, 21%, 22%, 23%, 24%, 25%, 26%, 27%, 28%, 29%, 30%, 31%, 32%, 33%, 34%, 35%, 36%, 37%, 38%, 39%, 40%, 41% 42%, 43%, 44%, 45%, 46%, 47%, 48%, 49%, or 50%); and
 a helper lipid at a molar ratio of 5% to 35%, 8% to 30%, or 10% to 30% (e.g., a helper lipid at a molar ratio of 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, or 35%),
 wherein all of the molar ratios are relative to the total lipid content of the LNP.

In certain embodiments, the LNP comprises: a cationic lipid at a molar ratio of 40%; a PEGylated lipid at a molar ratio of 1.5%; a cholesterol-based lipid at a molar ratio of 28.5%; and a helper lipid at a molar ratio of 30%.

In certain embodiments, the LNP of the disclosure comprises: a cationic lipid at a molar ratio of 45 to 50%; a PEGylated lipid at a molar ratio of 1.5 to 1.7%; a cholesterol-based lipid at a molar ratio of 38 to 43%; and a helper lipid at a molar ratio of 9 to 10%.

In certain embodiments, the PEGylated lipid is dimyristoyl-PEG2000 (DMG-PEG2000).

In various embodiments, the cholesterol-based lipid is cholesterol.

In some embodiments, the helper lipid is 1,2-dioleoyl-SN-glycero-3-phosphoethanolamine (DOPE).

In certain embodiments, the LNP comprises: OF-02 at a molar ratio of 35% to 55%; DMG-PEG2000 at a molar ratio of 0.25% to 2.75%; cholesterol at a molar ratio of 20% to 50%; and DOPE at a molar ratio of 5% to 35%.

In certain embodiments, the LNP comprises: cKK-E10 at a molar ratio of 35% to 55%; DMG-PEG2000 at a molar ratio of 0.25% to 2.75%; cholesterol at a molar ratio of 20% to 50%; and DOPE at a molar ratio of 5% to 35%.

In certain embodiments, the LNP comprises: GL-HEPES-E3-E10-DS-3-E18-1 at a molar ratio of 35% to 55%; DMG-PEG2000 at a molar ratio of 0.25% to 2.75%; cholesterol at a molar ratio of 20% to 50%; and DOPE at a molar ratio of 5% to 35%.

In certain embodiments, the LNP comprises: GL-HEPES-E3-E12-DS-4-E10 at a molar ratio of 35% to 55%; DMG- PEG2000 at a molar ratio of 0.25% to 2.75%; cholesterol at a molar ratio of 20% to 50%; and DOPE at a molar ratio of 5% to 35%.

In certain embodiments, the LNP comprises: GL-HEPES-E3-E12-DS-3-E14 at a molar ratio of 35% to 55%; DMG-PEG2000 at a molar ratio of 0.25% to 2.75%; cholesterol at a molar ratio of 20% to 50%; and DOPE at a molar ratio of 5% to 35%.

In certain embodiments, the LNP comprises: SM-102 at a molar ratio of 35% to 55%; DMG-PEG2000 at a molar ratio of 0.25% to 2.75%; cholesterol at a molar ratio of 20% to 50%; and DSPC at a molar ratio of 5% to 35%.

In certain embodiments, the LNP comprises: ALC-0315 at a molar ratio of 35% to 55%; ALC-0159 at a molar ratio of 0.25% to 2.75%; cholesterol at a molar ratio of 20% to 50%; and DSPC at a molar ratio of 5% to 35%.

In certain embodiments, the LNP comprises: OF-02 at a molar ratio of 40%; DMG-PEG2000 at a molar ratio of 1.5%; cholesterol at a molar ratio of 28.5%; and DOPE at a molar ratio of 30%. This LNP formulation is designated "Lipid A" herein.

In certain embodiments, the LNP comprises: cKK-E10 at a molar ratio of 40%; DMG-PEG2000 at a molar ratio of 1.5%; cholesterol at a molar ratio of 28.5%; and DOPE at a molar ratio of 30%. This LNP formulation is designated "Lipid B" herein.

In certain embodiments, the LNP comprises: GL-HEPES-E3-E10-DS-3-E18-1 at a molar ratio of 40%; DMG-PEG2000 at a molar ratio of 1.5%; cholesterol at a molar ratio of 28.5%; and DOPE at a molar ratio of 30%. This LNP formulation is designated "Lipid C" herein.

In certain embodiments, the LNP comprises: GL-HEPES-E3-E12-DS-4-E10 at a molar ratio of 40%; DMG-PEG2000 at a molar ratio of 1.5%; cholesterol at a molar ratio of 28.5%; and DOPE at a molar ratio of 30%. This LNP formulation is designated "Lipid D" herein.

In certain embodiments, the LNP comprises: GL-HEPES-E3-E 12-DS-3-E14 at a molar ratio of 40%; DMG-PEG2000 at a molar ratio of 1.5%; cholesterol at a molar ratio of 28.5%; and DOPE at a molar ratio of 30%. This LNP formulation is designated "Lipid E" herein.

In certain embodiments, the LNP comprises DLin-MC3-DMA (MC3) at a molar ratio of 50%; DMG-PEG2000 at a molar ratio of 1.5%; cholesterol at a molar ratio of 38.5%; and DSPC at a molar ratio of 10%. This LNP formulation is designated "Lipid F" herein.

In certain embodiments, the LNP comprises: IM-001 at a molar ratio of 40%; DMG-PEG2000 at a molar ratio of 1.5%; cholesterol at a molar ratio of 28.5%; and DOPE at a molar ratio of 30%. This LNP formulation is designated "Lipid G" herein.

In certain embodiments, the LNP comprises: 9-heptadecanyl 8-{(2-hydroxyethyl)[6-oxo-6-(undecyloxy)hexyl]amino}octanoate (SM-102) at a molar ratio of 50%; 1,2-distearoyl-sn-glycero-3-phosphocholine (DSPC) at a molar ratio of 10%; cholesterol at a molar ratio of 38.5%; and 1,2-dimyristoyl-rac-glycero-3-methoxypolyethylene glycol-2000 (DMG-PEG2000) at a molar ratio of 1.5%.

In certain embodiments, the LNP comprises: (4-hydroxybutyl)azanediyl]di(hexane-6,1-diyl) bis(2-hexyldecanoate) (ALC-0315) at a molar ratio of 46.3%; 1,2-distearoyl-sn-glycero-3-phosphocholine (DSPC) at a molar ratio of 9.4%; cholesterol at a molar ratio of 42.7%; and 2-[(polyethylene glycol)-2000]-N,N-ditetradecylacetamide (ALC-0159) at a molar ratio of 1.6%.

In certain embodiments, the LNP comprises: (4-hydroxybutyl)azanediyl]di(hexane-6,I-diyl) bis(2-hexyldecanoate) (ALC-0315) at a molar ratio of 47.4%; 1,2-distearoyl-sn-glycero-3-phosphocholine (DSPC) at a molar ratio of 10%; cholesterol at a molar ratio of 40.9%; and 2-[(polyethylene glycol)-2000]-N,N-ditetradecylacetamide (ALC-0159) at a molar ratio of 1.7%.

In certain embodiments, the LNP comprises 4,4'-[[[[3-(dimethylamino)propyl]thio]carbonyl]imino]bis-butanoic acid, 1,1'-bis(1-heptyloctyl) ester (ATX-126) at a molar ratio of 50%; DMG-PEG2000 at a molar ratio of 1.5%; cholesterol at a molar ratio of 38.5%; and DSPC at a molar ratio of 10%.

In some embodiments, the LNP formulation is as defined for "Lipid A", "Lipid B", "Lipid D", or Lipid G (e.g., Lipid D or Lipid G).

To calculate the actual amount of each lipid to be put into an LNP formulation, the molar amount of the cationic lipid is first determined based on a desired N/P ratio, where N is the number of nitrogen atoms in the cationic lipid and P is the number of phosphate groups in the mRNA to be transported by the LNP. Next, the molar amount of each of the other lipids is calculated based on the molar amount of the cationic lipid and the molar ratio selected. These molar amounts are then converted to weights using the molecular weight of each lipid.

F. Nucleic Acids within LNPs

The LNP compositions described herein may comprise a nucleic acid (e.g., a mRNA) of the present invention.

Where desired, the LNP may be multi-valent. In some embodiments, the LNP may carry nucleic acids, such as mRNAs, that encode more than one polypeptide of the present invention, such as two, three, four, five, six, seven, or eight polypeptides. For example, the LNP may carry multiple nucleic acids of the present invention (e.g., mRNA), each encoding a different polypeptide of the invention; or carry a polycistronic mRNA that can be translated into more than one polypeptide of the invention (e.g., each antigen-coding sequence is separated by a nucleotide linker encoding a self-cleaving peptide such as a 2A peptide). An LNP carrying different nucleic acids (e.g., mRNA) typically comprises (encapsulate) multiple copies of each nucleic acid. For example, an LNP carrying or encapsulating two different nucleic acids typically carries multiple copies of each of the two different nucleic acids.

In some embodiments, two or more (e.g., two, three or four) nucleic acids (e.g., mRNAs) as described herein encoding different polypeptides as described herein are co-encapsulated in the same LNP. For example, the LNPs described herein may co-encapsulate (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, and (c) a nucleic acid as described herein comprising a nucleotide sequence encoding a *Chlamydia* sp. CT443 polypeptide as described herein. In some embodiments, the LNPs described herein co-encapsulate (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, and (d) a nucleic acid as described herein comprising a nucleotide sequence encoding a *Chlamydia* sp. CT584 polypeptide as described herein. In some embodiments, the LNPs described herein co-encapsulate (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, (c) a nucleic acid as described herein comprising a nucleotide sequence encoding a *Chlamydia* sp. CT443 polypeptide as described herein, and (d) a nucleic acid as described herein comprising a nucleotide sequence encoding a *Chlamydia* sp. CT584 polypeptide as described herein.

Any two nucleic acids (e.g., two mRNAs) as described herein may be present in a weight ratio of 1:1. Any three nucleic acids (e.g., three mRNAs) as described herein may be present in a weight ratio of 1:1:1. Any four nucleic acids (e.g., four mRNAs) as described herein may be present in a weight ratio of 1:1:1:1.

In some embodiments, the LNP is as described herein (e.g., Lipid D or Lipid G).

Alternatively, any two or more (e.g., four) nucleic acids (e.g., mRNAs) encoding different polypeptides as described herein are encapsulated in separate LNPs.

In some embodiments, a single LNP formulation may comprise multiple kinds (e.g., two, three, four, five, six, seven, eight, nine, ten, or more) of LNPs, each kind carrying a different nucleic acid (e.g., mRNA).

When the nucleic acid is mRNA, the mRNA may be unmodified (i.e., containing only natural ribonucleotides A, U, C, and/or G linked by phosphodiester bonds), or chemically modified (e.g., including nucleotide analogs such as pseudouridines (e.g., N-1-methyl pseudouridine), 2'-fluoro ribonucleotides, and 2'-methoxy ribonucleotides, and/or phosphorothioate bonds). The mRNA molecule may comprise a 5' cap and a polyA tail.

G. Buffer and Other Components

To stabilize the nucleic acid and/or LNPs (e.g., to prolong the shelf-life of the vaccine product), to facilitate administration of the LNP pharmaceutical composition, and/or to enhance in vivo expression of the nucleic acid, the nucleic acid and/or LNP can be formulated in combination with one or more carriers, targeting ligands, stabilizing reagents (e.g., preservatives and antioxidants), and/or other pharmaceutically acceptable excipients. Examples of such excipients are parabens, thimerosal, thiomersal, chlorobutanol, benzalkonium chloride, and chelators (e.g., EDTA).

The LNP compositions of the present disclosure can be provided as a frozen liquid form or a lyophilized form. A variety of cryoprotectants may be used, including, without limitations, sucrose, trehalose, glucose, mannitol, mannose, dextrose, and the like. The cryoprotectant may constitute 5-30% (w/v) of the LNP composition. In some embodiments, the LNP composition comprises trehalose, e.g., at 5-30% (e.g., 10%) (w/v). Once formulated with the cryoprotectant, the LNP compositions may be frozen (or lyophilized and cryopreserved) at −20° C. to −80° C.

The LNP compositions may be provided to a patient in an aqueous buffered solution—thawed if previously frozen, or if previously lyophilized, reconstituted in an aqueous buffered solution at bedside. The buffered solution is for example isotonic and suitable for e.g., intramuscular or intradermal injection. In some embodiments, the buffered solution is a phosphate-buffered saline (PBS).

Nucleic Acids

A nucleic acid of the invention may be RNA or DNA. The nucleic acids of the invention may be single or double-stranded. In certain embodiments, the nucleic acid is RNA, e.g., mRNA.

mRNA

In some embodiments, the nucleic acids of the present invention are messenger RNAs (mRNAs). mRNAs can be modified or unmodified. mRNAs may contain one or more coding and non-coding regions. A coding region is alternatively referred to as an open reading frame (ORF). Non-coding regions in an mRNA include the 5' cap, 5' untranslated region (UTR), 3' UTR, and a polyA tail. An mRNA can be purified from natural sources, produced using recombinant expression systems (e.g., in vitro transcription) and optionally purified, or chemically synthesised.

In certain embodiments, the mRNA comprises an ORF encoding an antigen of interest. In certain embodiments, the RNA (e.g., mRNA) further comprises at least one 5' UTR, 3' UTR, a poly(A) tail, and/or a 5' cap. In some embodiments, the mRNA comprises (i) a 5' cap as defined herein; (ii) a 5' untranslated region (UTR) as defined herein; (iii) a protein coding region; (iv) a 3' UTR as defined herein; and (v) a polyA tail. Typically, the 3' end of (i) bonds directly to the 5' end of (ii) via a 3' to 5' phosphodiester linkage; the 3' end of (ii) bonds directly to the 5' end of (iii) via a 3' to 5' phosphodiester linkage; the 3' end of (iii) bonds directly to the 5' end of (iv) via a 3' to 5' phosphodiester linkage; and the 3' end of (iv) bonds directly to the 5' end of (v) via a 3' to 5' phosphodiester linkage.

In certain embodiments, the mRNA comprises at least one, at least two, at least three or more stop codon(s), wherein the stop codon(s) can be selected from UAA, UGA and UAG, and wherein the at least two, at least three or more stop codon(s) can be identical or different. Typically, the at least one stop codon comprises UAA or UGA (e.g., UAA). Typically, the at least two stop codons comprise at least two identical stop codons, such as UAA or UGA (e.g., UAAUAA or UGAUGA) or at least two different stop codons, which may in particular be selected from UAA and UGA (e.g., UGAUAA). Typically, the at least three stop codons comprise UAA, UGA and UAG (e.g., UGAUAAUAG).

An mRNA sequence is presented in the 5' to 3' direction unless otherwise indicated.

5'Cap

An mRNA 5' cap can provide resistance to nucleases found in most eukaryotic cells and promote translation efficiency. Several types of 5' caps are known. A 7-methylguanosine cap (also referred to as "$m^7G$" or "Cap-0"), comprises a guanosine that is linked through a 5'-5'-triphosphate bond to the first transcribed nucleotide.

A 5' cap is typically added as follows: first, an RNA terminal phosphatase removes one of the terminal phosphate groups from the 5' nucleotide, leaving two terminal phosphates; guanosine triphosphate (GTP) is then added to the terminal phosphates via a guanylyl transferase, producing a 5' 5' 5 triphosphate linkage; and the 7-nitrogen of guanine is then methylated by a methyltransferase. Examples of cap structures include, but are not limited to, m7G(5')ppp, (5'(A,G(5')ppp(5')A, and G(5')ppp(5')G. Additional cap structures are described in U.S. Publication No. US 2016/0032356 and U.S. Publication No. US 2018/0125989, which are incorporated herein by reference.

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5')G (the ARCA cap); G(5')ppp(5')A; G(5')ppp(5')G; m7G(5')ppp(5')A; m7G(5')ppp(5')G; m7G(5')ppp(5')(2'OMeA)pG; m7G(5')ppp(5')(2'OMeA)pU; m7G(5')ppp(5')(2'OMeG)pG (New England BioLabs, Ipswich, MA; TriLink Biotechnologies). 5'-capping of modified RNA may be completed post-transcriptionally using a vaccinia virus capping enzyme to generate the Cap 0 structure: m7G(5')ppp(5')G. Cap 1 structure may be generated using both vaccinia virus capping enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase.

In certain embodiments, the mRNA of the invention comprises a 5' cap selected from the group consisting of 3'-O-Me-m7G(5')ppp(5')G (the ARCA cap), G(5')ppp(5')A, G(5')ppp(5')G, m7G(5')ppp(5')A, m7G(5')ppp(5')G, m7G(5')ppp(5')(2'OMeA)pG, m7G(5')ppp(5')(2'OMeA)pU, and m7G(5')ppp(5')(2'OMeG)pG.

In certain embodiments, the mRNA of the invention comprises a 5' cap of:

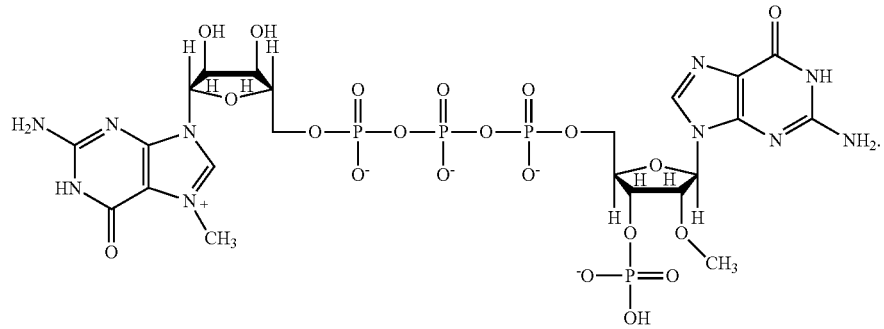

Untranslated Region (UTR)

In some embodiments, the mRNA of the invention includes a 5' and/or 3' untranslated region (UTR). In mRNA, the 5' UTR starts at the transcription start site and continues to the start codon but does not include the start codon. The 3' UTR starts immediately following the stop codon and continues until the transcriptional termination signal.

In some embodiments, the mRNA disclosed herein may comprise a 5' UTR that includes one or more elements that affect an mRNA's stability or translation. In some embodiments, a 5' UTR may be about 10 to 5,000 nucleotides in length. In some embodiments, a 5' UTR may be about 50 to 500 nucleotides in length. In some embodiments, the 5' UTR is at least about 10 nucleotides in length, about 20 nucleotides in length, about 30 nucleotides in length, about 40 nucleotides in length, about 50 nucleotides in length, about 100 nucleotides in length, about 150 nucleotides in length, about 200 nucleotides in length, about 250 nucleotides in length, about 300 nucleotides in length, about 350 nucleotides in length, about 400 nucleotides in length, about 450 nucleotides in length, about 500 nucleotides in length, about 550 nucleotides in length, about 600 nucleotides in length, about 650 nucleotides in length, about 700 nucleotides in length, about 750 nucleotides in length, about 800 nucleotides in length, about 850 nucleotides in length, about 900 nucleotides in length, about 950 nucleotides in length, about 1,000 nucleotides in length, about 1,500 nucleotides in length, about 2,000 nucleotides in length, about 2,500 nucleotides in length, about 3,000 nucleotides in length, about 3,500 nucleotides in length, about 4,000 nucleotides in length, about 4,500 nucleotides in length or about 5,000 nucleotides in length.

In some embodiments, the mRNA disclosed herein may comprise a 3' UTR comprising one or more of a polyadenylation signal, a binding site for proteins that affect an mRNA's stability of location in a cell, or one or more binding sites for miRNAs. In some embodiments, a 3' UTR may be 50 to 5,000 nucleotides in length or longer. In some embodiments, a 3' UTR may be 50 to 1,000 nucleotides in length or longer. In some embodiments, the 3' UTR is at least about 50 nucleotides in length, about 100 nucleotides in length, about 150 nucleotides in length, about 200 nucleotides in length, about 250 nucleotides in length, about 300 nucleotides in length, about 350 nucleotides in length, about 400 nucleotides in length, about 450 nucleotides in length, about 500 nucleotides in length, about 550 nucleotides in length, about 600 nucleotides in length, about 650 nucleotides in length, about 700 nucleotides in length, about 750 nucleotides in length, about 800 nucleotides in length, about 850 nucleotides in length, about 900 nucleotides in length, about 950 nucleotides in length, about 1,000 nucleotides in length, about 1,500 nucleotides in length, about 2,000 nucleotides in length, about 2,500 nucleotides in length, about 3,000 nucleotides in length, about 3,500 nucleotides in length, about 4,000 nucleotides in length, about 4,500 nucleotides in length, or about 5,000 nucleotides in length.

In some embodiments, the mRNA disclosed herein may comprise a 5' or 3' UTR that is derived from a gene distinct from the one encoded by the mRNA transcript (i.e., the UTR is a heterologous UTR).

In certain embodiments, the 5' and/or 3' UTR sequences can be derived from mRNA which are stable (e.g., globin, actin, GAPDH, tubulin, histone, or citric acid cycle enzymes) to increase the stability of the mRNA. For example, a 5' UTR sequence may include a partial sequence of a CMV immediate-early 1 (IE1) gene, or a fragment thereof, to improve the nuclease resistance and/or improve the half-life of the mRNA. Also contemplated is the inclusion of a sequence encoding human growth hormone (hGH), or a fragment thereof, to the 3' end or untranslated region of the mRNA. Generally, these modifications improve the stability and/or pharmacokinetic properties (e.g., half-life) of the mRNA relative to their unmodified counterparts, and include, for example, modifications made to improve such mRNA resistance to in vivo nuclease digestion.

Exemplary 5' UTRs include a sequence derived from a CMV immediate-early 1 (IE1) gene (U.S. Publication Nos. 2014/0206753 and 2015/0157565, each of which is incorporated herein by reference), or the sequence GGGAUCC-UACC (SEQ ID NO: 837) (U.S. Publication No. 2016/0151409, incorporated herein by reference).

In various embodiments, the 5' UTR may be derived from the 5' UTR of a TOP gene. TOP genes are typically characterized by the presence of a 5'-terminal oligopyrimidine (TOP) tract. Furthermore, most TOP genes are characterized by growth-associated translational regulation. However, TOP genes with a tissue specific translational regulation are also known. In certain embodiments, the 5' UTR derived from the 5' UTR of a TOP gene lacks the 5' TOP motif (the oligopyrimidine tract) (e.g., U.S. Publication Nos. 2017/0029847, 2016/0304883, 2016/0235864, and 2016/0166710, each of which is incorporated herein by reference).

In certain embodiments, the 5' UTR is derived from a ribosomal protein Large 32 (L32) gene (U.S. Publication No. 2017/0029847, supra).

In certain embodiments, the 5' UTR is derived from the 5' UTR of an hydroxysteroid (17-b) dehydrogenase 4 gene (HSD17B4) (U.S. Publication No. 2016/0166710, supra).

In certain embodiments, the 5' UTR is derived from the 5' UTR of an ATP5A1 gene (U.S. Publication No. 2016/0166710, supra).

In some embodiments, an internal ribosome entry site (IRES) is used instead of a 5' UTR.

In some embodiments, the 5'UTR comprises a nucleic acid sequence set forth in SEQ ID NO: 838 and reproduced below:

```
                                          (SEQ ID NO: 838)
       GGACAGAUCGCCUGGAGACGCCAUCCACGC

UGUUUUGACCUCCAUAGAAGACACCGGGAC

CGAUCCAGCCUCCGCGGCCGGGAACGGUGC

AUUGGAACGCGGAUUCCCCGUGCCAAGAGU

GACUCACCGUCCUUGACACG
```

In some embodiments, the 3'UTR comprises a nucleic acid sequence set forth in SEQ ID NO: 839 and reproduced below:

```
                                          (SEQ ID NO: 839)
       CGGGUGGCAUCCCUGUGACCCCUCCCCAGU

GCCUCUCCUGGCCCUGGAAGUUGCCACUCC

AGUGCCCACCAGCCUUGUCCUAAUAAAAUU

AAGUUGCAUC
```

The 5' UTR and 3'UTR are described in further detail in WO2012/075040, incorporated herein by reference.

Polyadenylated Tail

As used herein, the terms "poly(A) sequence," "poly(A) tail," and "poly(A) region" refer to a sequence of adenosine nucleotides at the 3' end of the mRNA molecule. The poly(A) tail may confer stability to the mRNA and protect it from exonuclease degradation. The poly(A) tail may enhance translation. In some embodiments, the poly(A) tail is essentially homopolymeric. For example, a poly(A) tail of 100 adenosine nucleotides may have essentially a length of 100 nucleotides. In certain embodiments, the poly(A) tail may be interrupted by at least one nucleotide different from an adenosine nucleotide (e.g., a nucleotide that is not an adenosine nucleotide). For example, a poly(A) tail of 100 adenosine nucleotides may have a length of more than 100 nucleotides (comprising 100 adenosine nucleotides and at least one nucleotide, or a stretch of nucleotides, that are different from an adenosine nucleotide). In certain embodiments, the poly(A) tail comprises the sequence

```
                                          (SEQ ID NO: 840)
            AAAAAAAAAAAAAAAAAAAAAAAAAAAAAA

GCAUAUGACUAAAAAAAAAAAAAAAAAAAA

AAAAAAAAAAAAAAAAAAAAAAAAAAAAAA

AAAAAAAAAAAAAAAAAAA.
```

The "poly(A) tail," as used herein, typically relates to RNA. However, in the context of the disclosure, the term likewise relates to corresponding sequences in a DNA molecule (e.g., a "poly(T) sequence").

The poly(A) tail may comprise about 10 to about 500 adenosine nucleotides, about 10 to about 200 adenosine nucleotides, about 40 to about 200 adenosine nucleotides, or about 40 to about 150 adenosine nucleotides. The length of the poly(A) tail may be at least about 10, 50, 75, 100, 150, 200, 250, 300, 350, 400, 450, or 500 adenosine nucleotides. In some embodiments, the polyA tail comprises at least 50, at least 75 or at least 100 adenosine nucleotides.

In some embodiments where the nucleic acid is an RNA, the poly(A) tail of the nucleic acid is obtained from a DNA template during RNA in vitro transcription. In certain embodiments, the poly(A) tail is obtained in vitro by common methods of chemical synthesis without being transcribed from a DNA template. In various embodiments, poly(A) tails are generated by enzymatic polyadenylation of the RNA (after RNA in vitro transcription) using commercially available polyadenylation kits and corresponding protocols, or alternatively, by using immobilized poly(A)polymerases, e.g., using methods and means as described in WO2016/174271.

The nucleic acid may comprise a poly(A) tail obtained by enzymatic polyadenylation, wherein the majority of nucleic acid molecules comprise about 100 (+/−20) to about 500 (+1-50) or about 250 (+/−20) adenosine nucleotides.

In some embodiments, the nucleic acid may comprise a poly(A) tail derived from a template DNA and may additionally comprise at least one additional poly(A) tail generated by enzymatic polyadenylation, e.g., as described in WO2016/091391.

In certain embodiments, the nucleic acid comprises at least one polyadenylation signal.

In various embodiments, the nucleic acid may comprise at least one poly(C) sequence.

The term "poly(C) sequence," as used herein, is intended to be a sequence of cytosine nucleotides of up to about 200 cytosine nucleotides. In some embodiments, the poly(C) sequence comprises about 10 to about 200 cytosine nucleotides, about 10 to about 100 cytosine nucleotides, about 20 to about 70 cytosine nucleotides, about 20 to about 60 cytosine nucleotides, or about 10 to about 40 cytosine nucleotides. In some embodiments, the poly(C) sequence comprises about 30 cytosine nucleotides.

Chemical Modification

The mRNA disclosed herein may be modified or unmodified. Typically, the mRNA comprises at least one chemical modification. In some embodiments, the mRNA disclosed herein may contain one or more modifications that typically enhance RNA stability. Exemplary modifications can include backbone modifications, sugar modifications, or base modifications. In some embodiments, the disclosed mRNA may be synthesized from naturally occurring nucleotides and/or nucleotide analogues (modified nucleotides) including, but not limited to, purines (adenine (A) and guanine (G)) or pyrimidines (thymine (T), cytosine (C), and uracil (U)). In certain embodiments, the disclosed mRNA may be synthesized from modified nucleotide analogues or derivatives of purines and pyrimidines, such as, e.g., 1-methyl-adenine, 2-methyl-adenine, 2-methylthio-N-6-isopentenyl-adenine, N6-methyl-adenine, N6-isopentenyl-adenine, 2-thio-cytosine, 3-methyl-cytosine, 4-acetyl-cytosine, 5-methyl-cytosine, 2,6-diaminopurine, 1-methyl-guanine, 2-methyl-guanine, 2,2-dimethyl-guanine, 7-methyl-guanine, inosine, 1-methyl-inosine, pseudouracil (5-uracil), dihydro-uracil, 2-thio-uracil, 4-thio-uracil, 5-carboxymethylaminomethyl-2-thio-uracil, 5-(carboxyhydroxymethyl)-uracil, 5-fluoro-uracil, 5-bromo-uracil, 5-carboxymethylaminomethyl-uracil, 5-methyl-2-thio-uracil, 5-methyluracil, N-uracil-5-oxy acetic acid methyl ester, 5-methylaminomethyl-uracil, 5-methoxyaminomethyl-2-thio-uracil, 5'-methoxycarbonylmethyl-uracil, 5-methoxy-uracil, uracil-5-oxyacetic acid methyl ester, uracil-5-oxyacetic acid (v), 1-methyl-pseudouracil, queosine, P-D-mannosyl-queosine, phosphoramidates, phosphorothioates, peptide nucleotides, methylphosphonates, 7-deazaguanosine, 5-methylcytosine, and inosine.

In some embodiments, the disclosed mRNA may comprise at least one chemical modification including, but not limited to, pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methyluridine, 5-methoxyuridine, and 2'-O-methyl uridine.

In some embodiments, the chemical modification is selected from the group consisting of pseudouridine, N1-methylpseudouridine, 5-methylcytosine, 5-methoxyuridine, and a combination thereof.

In some embodiments, the chemical modification comprises N1-methylpseudouridine. Typically, the chemical modification comprises N1-methylpseudouridine. Typically, the chemical modification comprises N1-methylpseudouridine in place of every uridine, i.e. 100% of U residues are N1-methylpseudouridine.

In some embodiments, at least 20%, at least 30%, at least 40%, at least 50%, at least 60%, at least 70%, at least 80%, at least 85%, at least 90%, at least 95%, or 100% of the uracil nucleotides in the mRNA are chemically modified.

In some embodiments, at least 20%, at least 30%, at least 40%, at least 50%, at least 60%, at least 70%, at least 80%, at least 85%, at least 90%, at least 95%, or 100% of the uracil nucleotides in the ORF are chemically modified.

The preparation of such analogues is described, e.g., in U.S. Pat. Nos. 4,373,071, 4,401,796, 4,415,732, 4,458,066, 4,500,707, 4,668,777, 4,973,679, 5,047,524, 5,132,418, 5,153,319, 5,262,530, and 5,700,642.

mRNA Synthesis

The mRNAs disclosed herein may be synthesized according to any of a variety of methods. For example, mRNAs according to the present disclosure may be synthesized via in vitro transcription (IVT). Some methods for in vitro transcription are described, e.g., in Geall et al. (2013) Semin. Immunol. 25(2): 152-159; Brunelle et al. (2013) Methods Enzymol. 530:101-14. Briefly, IVT is typically performed with a linear or circular DNA template containing a promoter, a pool of ribonucleotide triphosphates, a buffer system that may include DTT and magnesium ions, an appropriate RNA polymerase (e.g., T3, T7, or SP6 RNA polymerase), DNase I, pyrophosphatase, and/or RNase inhibitor. The exact conditions may vary according to the specific application. The presence of these reagents is generally undesirable in a final mRNA product and these reagents can be considered impurities or contaminants which can be purified or removed to provide a clean and/or homogeneous mRNA that is suitable for therapeutic use. While mRNA provided from in vitro transcription reactions may be desirable in some embodiments, other sources of mRNA can be used according to the instant disclosure including wild-type mRNA produced from bacteria, fungi, plants, and/or animals.

Processes for Making Present LNP Compositions

The present LNPs can be prepared by various techniques presently known in the art. For example, multilamellar vesicles (MLV) may be prepared according to conventional techniques, such as by depositing a selected lipid on the inside wall of a suitable container or vessel by dissolving the lipid in an appropriate solvent, and then evaporating the solvent to leave a thin film on the inside of the vessel or by spray drying. An aqueous phase may then be added to the vessel with a vortexing motion that results in the formation of MLVs. Unilamellar vesicles (ULV) can then be formed by homogenization, sonication or extrusion of the multilamellar vesicles. In addition, unilamellar vesicles can be formed by detergent removal techniques.

Various methods are described in US 2011/0244026, US 2016/0038432, US 2018/0153822, US 2018/0125989, and PCT/US2020/043223 (filed Jul. 23, 2020) and can be used to practice the present disclosure. One exemplary process entails encapsulating mRNA by mixing it with a mixture of lipids, without first pre-forming the lipids into lipid nanoparticles, as described in US 2016/0038432. Another exemplary process entails encapsulating mRNA by mixing pre-formed LNPs with mRNA, as described in US 2018/0153822.

In some embodiments, the process of preparing mRNA-loaded LNPs includes a step of heating one or more of the solutions to a temperature greater than ambient temperature, the one or more solutions being the solution comprising the pre-formed lipid nanoparticles, the solution comprising the mRNA and the mixed solution comprising the LNP-encapsulated mRNA. In some embodiments, the process includes the step of heating one or both of the mRNA solution and the pre-formed LNP solution, prior to the mixing step. In some embodiments, the process includes heating one or more of the solutions comprising the pre-formed LNPs, the solution comprising the mRNA and the solution comprising the LNP-encapsulated mRNA, during the mixing step. In some embodiments, the process includes the step of heating the LNP-encapsulated mRNA, after the mixing step. In some embodiments, the temperature to which one or more of the solutions is heated is or is greater than about 30° C., 37° C., 40° C., 45° C., 50° C., 55° C., 60° C., 65° C., or 70° C. In some embodiments, the temperature to which one or more of the solutions is heated ranges from about 25-70° C., about 30-70° C., about 35-70° C., about 40-70° C., about 45-70° C., about 50-70° C., or about 60-70° C. In some embodiments, the temperature is about 65° C.

Various methods may be used to prepare an mRNA solution suitable for the present disclosure. In some embodiments, mRNA may be directly dissolved in a buffer solution described herein. In some embodiments, an mRNA solution may be generated by mixing an mRNA stock solution with a buffer solution prior to mixing with a lipid solution for encapsulation. In some embodiments, an mRNA solution may be generated by mixing an mRNA stock solution with a buffer solution immediately before mixing with a lipid solution for encapsulation. In some embodiments, a suitable mRNA stock solution may contain mRNA in water or a buffer at a concentration at or greater than about 0.2 mg/ml, 0.4 mg/ml, 0.5 mg/ml, 0.6 mg/ml, 0.8 mg/ml, 1.0 mg/ml, 1.2 mg/ml, 1.4 mg/ml, 1.5 mg/ml, or 1.6 mg/ml, 2.0 mg/ml, 2.5 mg/ml, 3.0 mg/ml, 3.5 mg/ml, 4.0 mg/ml, 4.5 mg/ml, or 5.0 mg/ml.

In some embodiments, an mRNA stock solution is mixed with a buffer solution using a pump. Exemplary pumps include but are not limited to gear pumps, peristaltic pumps and centrifugal pumps. Typically, the buffer solution is mixed at a rate greater than that of the mRNA stock solution. For example, the buffer solution may be mixed at a rate at least 1×, 2×, 3×, 4×, 5×, 6×, 7×, 8×, 9×, 10×, 15×, or 20× greater than the rate of the mRNA stock solution. In some embodiments, a buffer solution is mixed at a flow rate ranging between about 100-6000 ml/minute (e.g., about 100-300 ml/minute, 300-600 ml/minute, 600-1200 ml/minute, 1200-2400 ml/minute, 2400-3600 ml/minute, 3600-4800 ml/minute, 4800-6000 ml/minute, or 60-420 ml/minute). In some embodiments, a buffer solution is mixed at a flow rate of, or greater than, about 60 ml/minute, 100 ml/minute, 140 ml/minute, 180 ml/minute, 220 ml/minute, 260 ml/minute, 300 ml/minute, 340 ml/minute, 380 ml/minute, 420 ml/minute, 480 ml/minute, 540 ml/minute, 600 ml/minute, 1200 ml/minute, 2400 ml/minute, 3600 ml/minute, 4800 ml/minute, or 6000 ml/minute.

In some embodiments, an mRNA stock solution is mixed at a flow rate ranging between about 10-600 ml/minute (e.g., about 5-50 ml/minute, about 10-30 ml/minute, about 30-60 ml/minute, about 60-120 ml/minute, about 120-240 ml/minute, about 240-360 ml/minute, about 360-480 ml/minute, or about 480-600 ml/minute). In some embodiments, an mRNA stock solution is mixed at a flow rate of or greater than about 5 ml/minute, 10 ml/minute, 15 ml/minute, 20 ml/minute, 25 ml/minute, 30 ml/minute, 35 ml/minute, 40 ml/minute, 45 ml/minute, 50 ml/minute, 60 ml/minute, 80 ml/minute, 100 ml/minute, 200 ml/minute, 300 ml/minute, 400 ml/minute, 500 ml/minute, or 600 ml/minute.

The process of incorporation of a desired mRNA into a lipid nanoparticle is referred to as "loading." Exemplary methods are described in Lasic et al., FEBS Lett. (1992) 312:255-8. The LNP-incorporated nucleic acids may be completely or partially located in the interior space of the lipid nanoparticle, within the bilayer membrane of the lipid nanoparticle, or associated with the exterior surface of the lipid nanoparticle membrane. The incorporation of an mRNA into lipid nanoparticles is also referred to herein as "encapsulation" wherein the nucleic acid is entirely or substantially contained within the interior space of the lipid nanoparticle.

Suitable LNPs may be made in various sizes. In some embodiments, decreased size of lipid nanoparticles is associated with more efficient delivery of an mRNA. Selection of an appropriate LNP size may take into consideration the site of the target cell or tissue and to some extent the application for which the lipid nanoparticle is being made.

A variety of methods known in the art are available for sizing of a population of lipid nanoparticles. Exemplary methods herein utilize Zetasizer Nano ZS (Malvern Panalytical) to measure LNP particle size. In one protocol, 10 µl of an LNP sample are mixed with 990 µl of 10% trehalose. This solution is loaded into a cuvette and then put into the Zetasizer machine. The z-average diameter (nm), or cumulants mean, is regarded as the average size for the LNPs in the sample. The Zetasizer machine can also be used to measure the polydispersity index (PDI) by using dynamic light scattering (DLS) and cumulant analysis of the autocorrelation function. Average LNP diameter may be reduced by sonication of formed LNP. Intermittent sonication cycles may be alternated with quasi-elastic light scattering (QELS) assessment to guide efficient lipid nanoparticle synthesis.

In some embodiments, the majority of purified LNPs, i.e., greater than about 50%, 55%, 60%, 65%, 70%, 75%, 80%, 85%, 90%, 95%, 96%, 97%, 98%, or 99% of the LNPs, have a size of about 70-150 nm (e.g., about 145 nm, about 140 nm, about 135 nm, about 130 nm, about 125 nm, about 120 nm, about 115 nm, about 110 nm, about 105 nm, about 100 nm, about 95 nm, about 90 nm, about 85 nm, or about 80 nm). In some embodiments, substantially all (e.g., greater than 80 or 90%) of the purified lipid nanoparticles have a size of about 70-150 nm (e.g., about 145 nm, about 140 nm, about 135 nm, about 130 nm, about 125 nm, about 120 nm, about 115 nm, about 110 nm, about 105 nm, about 100 nm, about 95 nm, about 90 nm, about 85 nm, or about 80 nm).

In some embodiments, the LNPs in the present composition have an average size of less than 150 nm, less than 120 nm, less than 100 nm, less than 90 nm, less than 80 nm, less than 70 nm, less than 60 nm, less than 50 nm, less than 30 nm, or less than 20 nm.

In some embodiments, greater than about 70%, 75%, 80%, 85%, 90%, 95%, 96%, 97%, 98%, 99% of the LNPs in the present composition have a size ranging from about 40-90 nm (e.g., about 45-85 nm, about 50-80 nm, about 55-75 nm, about 60-70 nm) or about 50-70 nm (e.g., 55-65 nm) are particular suitable for pulmonary delivery via nebulization.

In some embodiments, the dispersity, or measure of heterogeneity in size of molecules (PDI), of LNPs in a pharmaceutical composition provided by the present disclosure is less than about 0.5. In some embodiments, an LNP has a PDI of less than about 0.5, less than about 0.4, less than about 0.3, less than about 0.28, less than about 0.25, less than about 0.23, less than about 0.20, less than about 0.18, less than about 0.16, less than about 0.14, less than about 0.12, less than about 0.10, or less than about 0.08. The PDI may be measured by a Zetasizer machine as described above.

In some embodiments, greater than about 75%, 80%, 85%, 90%, 95%, 96%, 97%, 98%, or 99% of the purified LNPs in a pharmaceutical composition provided herein encapsulate an mRNA within each individual particle. In some embodiments, substantially all (e.g., greater than 80% or 90%) of the purified lipid nanoparticles in a pharmaceutical composition encapsulate an mRNA within each individual particle.

In some embodiments, a lipid nanoparticle has an encapsulation efficiency of between 50% and 99%; or greater than about 60, 65, 70, 75, 80, 85, 90, 92, 95, 98, or 99%. Typically, lipid nanoparticles for use herein have an encapsulation efficiency of at least 90% (e.g., at least 91, 92, 93, 94, or 95%).

In some embodiments, an LNP has a N/P ratio of between 1 and 10. In some embodiments, a lipid nanoparticle has a N/P ratio above 1, about 1, about 2, about 3, about 4, about 5, about 6, about 7, or about 8. In further embodiments, a typical LNP herein has an N/P ratio of 4.

In some embodiments, a pharmaceutical composition according to the present disclosure contains at least about 0.5 µg, 1 µg, 5 µg, 10 µg, 100 µg, 500 µg, or 1000 µg of encapsulated mRNA. In some embodiments, a pharmaceutical composition contains about 0.1 µg to 1000 µg, at least about 0.5 µg, at least about 0.8 µg, at least about 1 µg, at least about 5 µg, at least about 8 µg, at least about 10 µg, at least about 50 µg, at least about 100 µg, at least about 500 µg, or at least about 1000 µg of encapsulated mRNA.

In some embodiments, mRNA can be made by chemical synthesis or by in vitro transcription (IVT) of a DNA template. In this process, in an IVT process, a DNA template, such as a cDNA or pDNA template is used to produce an mRNA transcript and the DNA template is degraded by a DNase. The transcript is purified by depth filtration and tangential flow filtration (TFF). The purified transcript is further modified by adding a cap and a tail, and the modified RNA is purified again by depth filtration and TFF.

The mRNA is then prepared in an aqueous buffer and mixed with an amphiphilic solution containing the lipid components of the LNPs. An amphiphilic solution for dissolving the four lipid components of the LNPs may be an alcohol solution. In some embodiments, the alcohol is ethanol. The aqueous buffer may be, for example, a citrate, phosphate, acetate, or succinate buffer and may have a pH of about 3.0-7.0, e.g., about 3.5, about 4.0, about 4.5, about 5.0, about 5.5, about 6.0, or about 6.5. The buffer may contain other components such as a salt (e.g., sodium, potassium, and/or calcium salts). In particular embodiments, the aqueous buffer has 1 mM citrate, 150 mM NaCl, pH 3.5 or 4.5.

An exemplary process for making an mRNA-LNP composition involves mixing of a buffered mRNA solution with a solution of lipids in ethanol in a controlled homogeneous manner, where the ratio of lipids:mRNA is maintained throughout the mixing process. In this illustrative example, the mRNA is presented in an aqueous buffer containing citric acid monohydrate, tri-sodium citrate dihydrate, and sodium chloride. The mRNA solution is added to the solution (1 mM citrate buffer, 150 mM NaCl, pH 4.5). The lipid mixture of four lipids (e.g., a cationic lipid, a PEGylated lipid, a cholesterol-based lipid, and a helper lipid) is dissolved in ethanol. The aqueous mRNA solution and the ethanol lipid solution are mixed at a volume ratio of 4:1 in a "T" mixer with a near "pulseless" pump system. The resultant mixture is then subjected for downstream purification and buffer exchange. The buffer exchange may be achieved using dialysis cassettes or a TFF system. TFF may be used to concentrate and buffer-exchange the resulting nascent LNP immediately after formation via the T-mix process. The diafiltration process is a continuous operation, keeping the volume constant by adding appropriate buffer at the same rate as the permeate flow.

Vectors

In one aspect, disclosed herein are vectors comprising a nucleic acid disclosed herein. In some embodiments, mRNAs as described herein may be cloned into a vector. Vectors include, but are not limited to, a plasmid, a phagemid, a phage derivative, an animal virus, and a cosmid. Vectors also include expression vectors, replication vectors, probe generation vectors, sequencing vectors, and vectors optimized for in vitro transcription (IVT).

In certain embodiments, the vector can be used to express mRNA in a host cell. In various embodiments, the vector can be used as a template for IVT. The construction of optimally translated IVT mRNA suitable for therapeutic use is disclosed in detail in Sahin, et al. (2014). Nat. Rev. Drug Discov. 13, 759-780; Weissman (2015). Expert Rev. Vaccines 14, 265-281.

In some embodiments, the vectors disclosed herein can comprise at least the following, from 5' to 3': an RNA polymerase promoter; a polynucleotide sequence encoding a 5' UTR; a polynucleotide sequence encoding an ORF; a polynucleotide sequence encoding a 3' UTR; and a polynucleotide sequence encoding at least one RNA aptamer. In some embodiments, the vectors disclosed herein may comprise a polynucleotide sequence encoding a poly(A) sequence and/or a polyadenylation signal.

A variety of RNA polymerase promoters are known. In some embodiments, the promoter can be a T7 RNA polymerase promoter. Other useful promoters can include, but are not limited to, T3 and SP6 RNA polymerase promoters. Consensus nucleotide sequences for T7, T3, and SP6 promoters are known.

Also disclosed herein are host cells (e.g., mammalian cells, e.g., human cells) comprising the vectors or nucleic acids disclosed herein. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid or vector disclosed herein.

Vectors can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendorf, Hamburg, Germany), cationic liposome mediated transfection using lipofection, polymer encapsulation, peptide mediated transfection, biolistic particle delivery systems such as "gene guns" (see, for example, Nishikawa, et al. (2001). Hum Gene Ther. 12(8):861-70, or the TransIT-RNA transfection Kit (Mirus, Madison, WI).

Chemical means for introducing a vector into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present disclosure, in order to confirm the presence of the mRNA sequence in the host cell a variety of assays may be performed.

Self-Replicating RNA, Trans-Replicating RNA and Non-Replicating RNA

Typically, the nucleic acid molecules described herein are non-replicating RNAs. However, the nucleic acid molecules described herein may alternatively be self-replicating RNAs or trans-replicating RNAs.

Self-Replicating RNA

Self-replicating (or self-amplifying) RNA can be produced by using replication elements derived from, e.g., alphaviruses, and substituting the structural viral proteins with a nucleotide sequence encoding a protein of interest (e.g., a Chlamydia sp. antigen). A self-replicating RNA is typically a positive-strand molecule which can be directly translated after delivery to a cell, and this translation provides an RNA-dependent RNA polymerase which then produces both antisense and sense transcripts from the delivered RNA. Thus, the delivered RNA leads to the production of multiple daughter RNAs. These daughter RNAs, as well as collinear subgenomic transcripts, may be translated themselves to provide in situ expression of an encoded antigen, or may be transcribed to provide further transcripts with the same sense as the delivered RNA which are translated to provide in situ expression of the antigen. The overall result of this sequence of transcriptions is a large amplification in the number of the introduced replicon RNAs and so the encoded antigen becomes a major polypeptide product of the cells.

One suitable system for achieving self-replication in this manner is to use an alphavirus-based replicon. These replicons are positive stranded (positive sense-stranded) RNAs which lead to translation of a replicase (or replicase-transcriptase) after delivery to a cell. The replicase is translated as a polyprotein which auto-cleaves to provide a replication complex which creates genomic-strand copies of the positive-strand delivered RNA. These negative (−)-stranded transcripts can themselves be transcribed to give further copies of the positive-stranded parent RNA and also to give a subgenomic transcript which encodes the antigen. Translation of the subgenomic transcript thus leads to in situ expression of the antigen by the infected cell. Suitable alphavirus replicons can use a replicase from a Sindbis virus, a Semliki forest virus, an eastern equine encephalitis virus, a Venezuelan equine encephalitis virus, etc. Mutant or wild-type virus sequences can be used, e.g., the attenuated TC83 mutant of VEEV has been used in replicons, see the following reference: WO2005/113782, incorporated herein by reference.

In one embodiment, each self-replicating RNA described herein encodes (i) an RNA-dependent RNA polymerase which can transcribe RNA from the self-replicating RNA molecule and (ii) a *Chlamydia* sp. antigen. The polymerase can be an alphavirus replicase, e.g., comprising one or more of alphavirus proteins nsP1, nsP2, nsP3, and nsP4. Whereas natural alphavirus genomes encode structural virion proteins in addition to the non-structural replicase polyprotein, in certain embodiments, the self-replicating RNA molecules do not encode alphavirus structural proteins. Thus, the self-replicating RNA can lead to the production of genomic RNA copies of itself in a cell, but not to the production of RNA-containing virions.

The inability to produce these virions means that, unlike a wild-type alphavirus, the self-replicating RNA molecule cannot perpetuate itself in infectious form. The alphavirus structural proteins which are necessary for perpetuation in wild-type viruses are absent from self-replicating RNAs of the present disclosure and their place is taken by gene(s) encoding the immunogen of interest, such that the subgenomic transcript encodes the immunogen rather than the structural alphavirus virion proteins. Self-replicating RNA are described in further detail in WO2011005799, incorporated herein by reference.

Trans-Replicating RNA

Trans-replicating (or trans-amplifying) RNA possess similar elements as the self-replicating RNA described above. However, with trans replicating RNA, two separate RNA molecules are used. A first RNA molecule encodes for the RNA replicase described above (e.g., the alphavirus replicase) and a second RNA molecule encodes for the protein of interest (e.g., a *Chlamydia* sp. antigen described herein). The RNA replicase may replicate one or both of the first and second RNA molecule, thereby greatly increasing the copy number of RNA molecules encoding the protein of interest. Trans replicating RNA are described in further detail in WO2017162265, incorporated herein by reference.

Non-Replicating RNA

Non-replicating (or non-amplifying) RNA is an RNA without the ability to replicate itself.

Therapeutic Uses

In another aspect, the invention provides the polypeptides, nucleic acids, combinations or compositions of the present invention for use as a medicament. The invention also provides the use of the polypeptides, nucleic acids, combinations or compositions of the present invention for the manufacture of a medicament. The medicament may be used for treating or preventing a disease as described herein. The invention further provides a method of treating or preventing a disease comprising administering the polypeptides, nucleic acids, combinations or compositions of the present invention to a subject in need thereof. The polypeptides, nucleic acids, combinations or compositions of the present invention may, for example, be administered in an amount effective to treat or prevent the disease in the subject. Polypeptides, nucleic acids, combinations or compositions may thus be administered in an effective amount. Typically, the treatment is prophylactic.

In another aspect, the invention provides the polypeptides, nucleic acids, combinations or compositions of the present invention for use in treating or preventing a Chlamydia sp. infection in a subject (e.g., human). The invention also provides the use of the polypeptides, nucleic acids, combinations or compositions of the present invention for the manufacture of a medicament for treating or preventing a *Chlamydia* sp. infection in a subject (e.g., human). The invention further provides a method of treating or preventing a *Chlamydia* sp. infection in a subject (e.g., human), the method comprising administering the polypeptides, nucleic acids, combinations or compositions of the present invention to the subject. The polypeptides, nucleic acids, combinations or compositions of the present invention may, for example, be administered in an amount effective to treat or prevent a *Chlamydia* sp. infection in the subject (i.e. administered in an effective amount). The polypeptides, nucleic acids, combinations or compositions may be used for generating an immune response against *Chlamydia* sp. infection in a subject (e.g., human). In exemplary embodiments, the infection is a *C. trachomatis* infection.

The invention provides the polypeptides, nucleic acids, combinations or compositions of the present invention for use in treating or preventing trachoma (a disease of the eye caused by *C. trachomatis* infection), genital tract infection by *Chlamydia trachomatis*, lymphogranuloma venereum (a disease caused by *C. trachomatis*), oropharyngeal infection by *C. trachomatis* or a rectal infection by *C. trachomatis* in a subject (e.g., human). The invention also provides the use of the polypeptides, nucleic acids, combinations or compositions of the present invention for the manufacture of a medicament for treating or preventing trachoma caused by *C. trachomatis* infection, genital tract infection by *Chlamydia trachomatis*, lymphogranuloma venereum (a disease caused by *C. trachomatis*), oropharyngeal infection by *C. trachomatis* or a rectal infection by *C. trachomatis* in a subject (e.g., human). The invention further provides a method of treating or preventing a trachoma caused by *C. trachomatis* infection, genital tract infection by *Chlamydia trachomatis*, lymphogranuloma venereum caused by *C. trachomatis* infection, oropharyngeal infection by *C. trachomatis* or a rectal infection by *C. trachomatis* in a subject (e.g., human), the method comprising administering the polypeptides, nucleic acids, combinations or compositions of the present invention to the subject. The polypeptides, nucleic acids, combinations or compositions of the present invention may, for example, be administered in an amount effective to treat or prevent a trachoma caused by *C. trachomatis* infection, genital tract infection by *Chlamydia trachomatis*, lymphogranuloma venereum caused by *C. trachomatis* infection, oropharyngeal infection by *C. trachomatis* or a rectal infection by *C. trachomatis* in the subject (i.e. administered in an effective amount). In exemplary embodiments, the infection is a *C. trachomatis* infection. Trachoma may be caused by infection with *C. trachomatis* serovars A, B, Ba or C. Lymphogranuloma venereum may be caused by infection with *C. trachomatis* serovars L1, L2 and L3. Genital tract infection may be caused by serovars D-K. In exemplary embodiments, the *Chlamydia* sp. (e.g., *C. trachomatis*) infection is a genital tract infection.

The invention provides the polypeptides, nucleic acids, combinations or compositions of the present invention for use in a method of providing protective immunity against a *Chlamydia* sp. infection in a subject (e.g., human). The invention also provides the use of the polypeptides, nucleic acids, combinations or compositions of the present invention for the manufacture of a medicament for use in a method of providing protective immunity against a *Chlamydia* sp. infection in a subject (e.g., human). The invention further provides a method of providing protective immunity against a *Chlamydia* sp. infection in a subject (e.g., human), the method comprising administering the polypeptides, nucleic acids, combinations or compositions of the present invention to the subject. The polypeptides, nucleic acids, combinations or compositions of the present invention may, for example, be administered in an amount effective to providing protective immunity against a *Chlamydia* sp. infection in the subject (i.e. administered in an effective amount). In exemplary embodiments, the infection is a *C. trachomatis* infection.

The polypeptides, nucleic acids, combinations or compositions of the invention may elicit a T cell response (e.g., an antigen-specific T cell response) in a subject. The polypeptides, nucleic acids, combinations or compositions of the invention may elicit a CD4+ T cell response and/or a CD8+ T cell response (e.g., CD4+ cell response) in a subject. In some embodiments, the polypeptides, nucleic acids, combinations or compositions of the invention may elicit IFNγ-producing T cells such as IFNγ-producing CD4+ T cells and/or IFNγ-producing CD8+ T cells (e.g., IFNγ-producing CD4+ T cells) in a subject. In some embodiments, the polypeptides, nucleic acids, combinations or compositions of the invention may elicit CD4+ IFNγ+IL2+ TNFα+ T cells (i.e. CD4+ T cells which produce IFNγ, IL2 and TNFα). In some embodiments, the polypeptides, nucleic acids, combinations or compositions of the invention may elicit CD8+ IFNγ+IL2-TNFα+ T cells or CD8+ T cells which produce IFNγ and TNFα). In some embodiments, the polypeptides, nucleic acids, combinations or compositions of the invention may elicit a cross-serovar T cell immune response in a subject, i.e. a T cell immune response that is cross-reactive against two or more serovars of *Chlamydia* sp. (e.g., cross-reactive against two or more serovars of *C. trachomatis*). Cytokine production by T cells may be measured by intracellular cytokine staining of T cells, e.g., T cells obtained from a subject, or by detecting secreted cytokines (e.g., by ELISA). The polypeptides, nucleic acids, combinations or compositions of the invention may elicit a Th1 response (e.g., a Th1 T cell response) in a subject.

The polypeptides, nucleic acids, combinations or compositions of the invention may elicit an antibody (e.g., IgG) response in a subject, such as a neutralising antibody (IgG) response. The antibodies may be of any isotype (e.g., IgA, IgG, IgM i.e. an α, γ or μ heavy chain), but will generally be IgG. Within the IgG isotype, antibodies may be IgG1, IgG2, IgG3 or IgG4 subclass. The antibody may have a κ or a λ light chain. A "neutralising antibody" is an antibody which neutralises the biological effects of a *Chlamydia* sp. antigen in a subject. In some embodiments, the polypeptides, nucleic acids, combinations or compositions of the invention may elicit a cross-serovar antibody response in a subject, i.e. an antibody response that is cross-reactive against two or more serovars of *Chlamydia* sp. (e.g., cross-reactive against two or more serovars of *C. trachomatis*).

In some embodiments, the polypeptides, nucleic acids, combinations or compositions of the invention may elicit a T cell response as described herein and/or an antibody response as described herein.

Administration of a polypeptide, nucleic acid, combination or composition of the invention to a subject may enable the subject to produce a *Chlamydia* sp. antigen-responsive CD4 memory T cell population or CD8 memory T cell population (e.g., CD4 T cell memory population) on exposure to *Chlamydia* sp. bacteria or the *Chlamydia* sp. antigen. The *Chlamydia* sp.-responsive CD4 memory T cell population may confer "sterilizing" immunity (i.e. complete protective immunity) against re-infection.

Administration of a polypeptide, nucleic acid, combination or composition of the invention to a subject may enable the subject to produce a *Chlamydia* sp. antigen-responsive memory B cell population on exposure to *Chlamydia* sp. bacteria or the *Chlamydia* sp. antigen. The *Chlamydia* sp.-responsive memory B cell population may confer "sterilizing" immunity (i.e. complete protective immunity) against re-infection.

The polypeptides, nucleic acids, combinations or compositions of the invention may be used to induce a primary immune response and/or to boost an immune response.

The polypeptides, nucleic acids, combinations or compositions of the invention may be administered to a subject to allow the subject to develop and/or maintain sterilising immunity to a *Chlamydia* sp. infection. Protective immunity may be provided or augmented in an immunised subject following a *Chlamydia* sp. infection.

The polypeptides, nucleic acids, combinations or compositions of the invention may be used in a prime-boost vaccination regime. Protective immunity against a *Chlamydia* sp. infection according to the invention may be provided by administering a priming vaccine, comprising a polypeptide, nucleic acid, combinations or composition of the invention, followed by a booster vaccine. The booster vaccine may be the same as the primer vaccine.

In certain embodiments, the subject is a vertebrate, e.g., a mammal, such as a human or a veterinary mammal (e.g., cat, dog, horse, cow, sheep, cattle, deer, goat, pig, rodents (e.g., mice)). In exemplary embodiments, the subject is a human. The subject (e.g., the human subject) may be male or female. In some embodiments, human subjects may be 7-50 (e.g., 9-44) years old.

Modes of Administration

The polypeptides, nucleic acids, combinations or compositions of the present invention can be administered parenterally (e.g., intramuscularly, intradermally, subcutaneously, intraperitoneally, intravenously, or to the interstitial space of a tissue) or by rectal, oral, vaginal, topical, transdermal, intranasal, sublingual, ocular, aural, pulmonary or other mucosal administration. In some embodiments, the compositions of the invention are administered intramuscularly. In some embodiments, the compositions of the invention are delivered by mucosal administration.

In certain embodiments, a polypeptide, nucleic acids, combinations or composition (e.g., a composition) of the invention is provided for use in intramuscular (IM) injection. The polypeptide, nucleic acids, combinations or composition (e.g., the composition) can be administered to the thigh or the upper arm of a subject at, e.g., their deltoid muscle in the upper arm. In some embodiments, the polypeptide, nucleic acids, combinations or composition (e.g., the composition) is provided in a pre-filled syringe or injector (e.g., single-chambered or multi-chambered). Injection may be via a needle (e.g., a hypodermic needle), but needle-free injection may alternatively be used. A typical intramuscular dose is 0.5 ml. In some embodiments, the polypeptide, nucleic acids, combinations or composition (e.g., the composition) is provided for use in inhalation and is provided in a pre-filled pump, aerosolizer, or inhaler.

In certain embodiments, a polypeptide, nucleic acids, combinations or composition (e.g., a composition) of the invention is provided for use in skin injection, e.g., in the epidermis, the dermis or the hypodermis of the skin. In some embodiments, a composition is provided in a device suitable for skin injection, such as a needle (e.g., an epidermic, dermic or hypodermic needle), a needle free device, a microneedle device or a microprojection array device. Examples of microneedle or microprojection array devices suitable for the skin injection according to the invention are described in US20230270842A1, US20220339416A1, US20210085598A1, US20200246450A1, US20220143376A1, US20180264244A1, US20180263641A1, US20110245776A1.

The compositions of the invention may be used to elicit systemic and/or mucosal immunity.

Dosage treatment can be a single dose schedule or a multiple dose schedule. Multiple doses (e.g., two or three) may be used in a primary immunisation schedule and/or in a booster immunisation schedule. A primary dose schedule may be followed by a booster dose schedule. Multiple doses (e.g., two doses or three) will typically be administered at least 1 week apart (e.g., about 2 weeks, about 3 weeks, about 4 weeks, about 6 weeks, about 8 weeks, about 10 weeks, about 12 weeks, about 16 weeks, etc.) to subjects in need thereof to achieve the desired therapeutic or prophylactic effects. The doses (e.g., prime and booster doses) may be separated by an interval of e.g., 1 week, 2 weeks, 3 weeks, 4 weeks, one month, two months, three months, four months, five months, six months, one year, two years, five years, or ten years A composition of the invention may be in the form of an extemporaneous formulation, e.g., a composition of the invention may be lyophilised. Such compositions may be reconstituted with a physiological buffer (e.g., PBS) just before use. The compositions of the invention may be provided in the form of an aqueous solution or a frozen aqueous solution and can be directly administered to subjects without reconstitution (after thawing, if previously frozen).

In some embodiments of a composition comprising a mRNA as described herein, a single dose of the composition contains 1 to 400 µg, such as 1-50 µg, of a mRNA as described herein (e.g., monovalent or multivalent). For example, a single dose may contain about 2.5 µg, about 5 µg, about 7.5 µg, about 10 µg, about 12.5 µg, or about 15 µg of a mRNA described herein e.g., for intramuscular (IM) injection.

In some embodiments, the composition comprises two nucleic acids (e.g., two mRNAs) as described herein encoding different polypeptides as described herein and the nucleic acids is present in a weight ratio of 1:1. In some embodiments, the composition comprises three nucleic acids (e.g., three mRNAs) as described herein encoding different polypeptides as described herein and the nucleic acids are present in a weight ratio of 1:1:1. Typically, the LNPs described herein co-encapsulate (a) a nucleic acid as described herein comprising a nucleotide sequence encoding a modified MOMP polypeptide as described herein, (b) a nucleic acid as described herein comprising a nucleotide sequence encoding a chimeric MOMP VD polypeptide as described herein, (c) a nucleic acid as described herein comprising a nucleotide sequence encoding a Chlamydia sp. CT443 polypeptide as described herein, and (d) a nucleic acid as described herein comprising a nucleotide sequence encoding a Chlamydia sp. CT584 polypeptide as described herein. Typically, the composition comprises four nucleic acids (e.g., four mRNAs) as described herein encoding different polypeptides as described herein. Typically the nucleic acids are present in a weight ratio of 1:1:1:1.

In further embodiments, a composition of the invention may be provided as a multi-valent single dose contains multiple (e.g., 2, 3, or 4) kinds of LNPs, each for a different antigen, and each kind of LNP has an mRNA amount of, e.g., 2.5 µg, about 5 µg, about 7.5 µg, about 10 µg, about 12.5 g, or about 15 µg.

In some embodiments, the subject is administered one or more nucleic acid compositions of the present invention. The nucleic acid compositions may comprise a nucleic acid comprising a nucleotide sequence encoding a polypeptide antigen as described herein. The nucleic acid compositions may be administered simultaneously, separately or sequentially. In some embodiments, the subject is administered a nucleic acid combination of the present invention. The nucleic acid combinations include combinations of two or more nucleic acids as described herein. The nucleic acids within a combination may be administered simultaneously, separately or sequentially.

In some embodiments, the subject is administered one or more polypeptide compositions of the present invention. The polypeptide compositions may comprise a polypeptide antigen as described herein. The polypeptide compositions may be administered simultaneously, separately or sequentially. In some embodiments, the subject is administered a polypeptide combination of the present invention. The polypeptide combinations include combinations of two or more polypeptides as described herein. The nucleic acids within a combination may be administered simultaneously, separately or sequentially. In some embodiments, the subject is administered one or more nucleic acid compositions of the present invention and one or more polypeptide compositions of the invention. In some embodiments, the subject is administered a nucleic acid composition comprising a nucleotide sequence encoding a modified MOMP polypeptide (and optionally a nucleic acid composition comprising a nucleotide sequence encoding a chimeric MOMP VD polypeptide) and a polypeptide composition comprising one more polypeptides comprising a polypeptide sequence of a non-MOMP antigen. In some embodiments, the subject is administered two or more polypeptide compositions each comprising a polypeptide comprising a polypeptide sequence of a non-MOMP antigen. The nucleic acid composition and the one or more polypeptide compositions may be administered simultaneously, separately or sequentially.

Compositions administered separately or sequentially may be administered within 12 months of each other, within six months of each other, or within one month or less of each other (e.g., within 10 days). Compositions may be administered within 7 days, within 3 days, within 2 days, or within 24 hours of each other. Simultaneous administration may involve administering the compositions of the invention at the same time. Simultaneous administration may include administration of the compositions of the invention to a patient within 12 hours of each other, within 6 hours, within 3 hours, within 2 hours or within 1 hour of each other, typically within the same visit to a clinical centre.

The present invention also provides a kit comprising one or more compositions described herein in one or more containers or provides one or more composition as described herein in one or more containers and a physiological buffer for reconstitution in another container. The container(s) may contain a single-use dosage or multi-use dosage. The containers may be pre-treated glass vials or ampules. The kit may include instructions for use.

A method for the detection and quantification of antibodies against one or more of the polypeptides described herein in a serum sample is also provided herein. For example, antibodies against MOMP, CT443, and/or CT584 polypeptides may be detected and quantified. Detection and quantification of antibodies against each polypeptide may be performed separately or simultaneously, e.g., as a panel in a single multi-well plate. Thus, a multi-well plate comprising wells coated with each of the recombinant polypeptides MOMP, CT443, and CT584, is further provided herein.

Definitions

The term "comprising" encompasses "including" as well as "consisting" e.g., a composition "comprising" X may consist exclusively of X or may include something additional e.g., X+Y.

The term "about" in relation to a numerical value x is optional and means, for example, x+/−10%.

The term "a" or "an" entity refers to one or more of that entity; for example, "a nucleotide sequence" is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

The term "*Chlamydia* sp." as used herein refers to species of the genus *Chlamydia*, which comprises the species *Chlamydia* trachomatis, *Chlamydia* abortus, *Chlamydia* pneumoniae, *Chlamydia*, muridarum, *Chlamydia* psittaci, *Chlamydia* pecorum, *Chlamydia felis*, and *Chlamydia caviae*. In exemplary embodiments of the invention, the *Chlamydia* sp. is *C. trachomatis*.

As used herein, the term "effective amount" refers to an amount (e.g., of a nucleic acid, a polypeptide, a combination or a composition as described herein) sufficient to effect beneficial or desired results. An effective amount can be administered in one or more administrations, applications or dosages, and is not intended to be limited to a particular formulation or administration route. The term "effective amount" includes, e.g., therapeutically effective amount and/or prophylactically effective amount. The term "effective amount" as used herein refers to an amount (e.g., of a nucleic acid, a polypeptide, a combination or a composition as described herein) which is effective for producing some desired therapeutic or prophylactic effects in the treatment or prevention of an infection, disease, disorder and/or condition at a reasonable benefit/risk ratio applicable to any medical treatment.

The term "elementary body" refers to one of the forms of *Chlamydia* sp. bacteria. Elementary bodies may be released from infected cells and can be transmitted from one subject to another.

The term "fragment" or "variant" when referring to the polypeptides of the present disclosure include any polypeptides which retain at least some of the properties (e.g., specific antigenic property of the polypeptide or the ability of polypeptide to contribute to the induction of antibody binding) of the reference polypeptide. Fragments of polypeptides include N-terminally and/or C-terminally truncated fragments, e.g., C-terminal fragments and N-terminal fragments, as well as deletion fragments but do not include the naturally occurring full-length polypeptide (or mature polypeptide). A deletion fragment refers to a polypeptide with 1 or more internal amino acids deleted from the full-length polypeptide. Variants of polypeptides include fragments as described above, and also polypeptides with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions. Such variations (i.e. truncations and/or amino acid substitutions, deletions, or insertions) may occur either on the amino acid level or correspondingly on the nucleic acid level.

Identity with respect to a sequence is defined herein as the percentage of nucleic acid or amino acid residues in the candidate sequence that are identical with the reference amino acid sequence after aligning the sequences and introducing gaps, if necessary, to achieve the maximum percent sequence identity, and not considering any conservative substitutions as part of the sequence identity.

Sequence identity can be determined by standard methods that are commonly used to compare the similarity in position of the amino acids of two polypeptides or the nucleic acids of two polynucleotides. For example, using a computer program such as BLAST or FASTA, two polypeptides are aligned for optimal matching of their respective amino acids (either along the full length of one or both sequences or along a pre-determined portion of one or both sequences). The programs provide a default opening penalty and a default gap penalty, and a scoring matrix such as PAM 250 [a standard scoring matrix; see Dayhoff et al., in Atlas of Protein Sequence and Structure, vol. 5, supp. 3 (1978)] can be used in conjunction with the computer program. The percent identity can be calculated as: the total number of identical matches multiplied by 100 and then divided by the sum of the length of the longer sequence within the matched span and the number of gaps introduced into the shorter sequences in order to align the two sequences.

As used herein, the term "kit" refers to a packaged set of related components, such as one or more compounds or compositions and one or more related materials such as solvents, solutions, buffers, instructions, or desiccants.

The term "linked" or "attached" as used herein refers to a first amino acid sequence or nucleotide sequence covalently joined to a second amino acid sequence or nucleotide sequence, respectively (e.g., a secretion signal peptide amino acid sequence and/or a heterologous transmembrane domain amino acid sequence linked to a *Chlamydia* sp. polypeptide amino acid sequence). The first amino acid or nucleotide sequence can be directly joined to the second amino acid or nucleotide sequence or alternatively an intervening sequence can covalently join the first sequence to the second sequence. The term "linked" means not only a fusion of a first amino acid sequence to a second amino acid sequence at the C-terminus or the N-terminus, but also includes insertion of the whole first amino acid sequence (or the second amino acid sequence) into any two amino acids in the second amino acid sequence (or the first amino acid sequence, respectively). In one embodiment, the first amino acid sequence can be linked to a second amino acid sequence by a peptide bond or a linker. The first nucleotide sequence can be linked to a second nucleotide sequence by a phosphodiester bond or a linker. The linker can be a peptide or a polypeptide (for polypeptide chains) or a nucleotide or a nucleotide chain (for nucleotide chains) or any chemical moiety (for both polypeptide and polynucleotide chains). The term "linked" is also indicated by a hyphen (-).

The term "native" as used herein refers to naturally occurring sequences. For example, a native *Chlamydia* sp. MOMP polypeptide is a naturally occurring *Chlamydia* sp. MOMP polypeptide.

EMBODIMENTS

The invention includes at least the following numbered embodiments:

1. A nucleic acid comprising a nucleotide sequence encoding a modified Major Outer Membrane Protein (MOMP) polypeptide, wherein the modified MOMP polypeptide has an amino acid sequence comprising two or more conserved domain sequences of a native *Chlamydia* sp. MOMP polypeptide and a non-native loop sequence between the conserved domain sequences.
2. The nucleic acid of embodiment 1, wherein the *Chlamydia* sp. is *Chlamydia* trachomatis.
3. The nucleic acid of embodiment 1 or 2, wherein the modified MOMP polypeptide does not comprise a native *Chlamydia* sp. MOMP variable domain between the two or more conserved domain sequences.
4. The nucleic acid of any one of embodiments 1-3, wherein the modified MOMP polypeptide comprises five conserved domain sequences of a native *Chlamydia* sp. MOMP polypeptide, optionally wherein
   (i) the modified MOMP polypeptide comprises all five full-length conserved domains of a native *Chlamydia* sp. MOMP polypeptide;
   (ii) the conserved domain sequences of the modified MOMP polypeptide is least 95% identical to a conserved domain of a native MOMP polypeptide of a *Chlamydia* sp. of any serovar (e.g., a conserved domain as defined in Table 1);
   (iii) the conserved domains of the modified MOMP polypeptide collectively have at least 95% sequence identity to the conserved domains of a native MOMP polypeptide (e.g., serovar E MOMP); and/or
   (iv) the conserved domain sequences of the modified MOMP polypeptide lack up to 3 or 5 amino acids of a native *Chlamydia* sp. MOMP conserved domain sequence.
5. The nucleic acid of any one of embodiments 1-4, wherein
   (i) the modified MOMP polypeptide comprises a non-native loop sequence between each of the conserved domain sequences;
   (ii) the non-native loop sequence is no more than 40% identical to any native *Chlamydia* sp. MOMP VD (VD1, VD2, VD3 or VD4) sequences of any serovar (e.g., serovars D, E, F or G of *C. trachomatis*).
6. The nucleic acid of embodiment 4, wherein the modified MOMP polypeptide comprises four non-native loop sequences and does not comprise any native *Chlamydia* sp. MOMP variable domains between the conserved domain sequences.
7. The nucleic acid of any one of embodiments 1-6, wherein the modified MOMP polypeptide does not comprise any native *Chlamydia* sp. MOMP variable domains between any of the conserved domain sequences.
8. The nucleic acid of any one of embodiments 1-7, wherein
   (i) the non-native loop sequence is between 3 and 30 amino acids in length, e.g., between 4 and 20 amino acids in length; and/or
   (ii) the two or more conserved domain sequences are linked by a non-native loop sequence such that the conserved domain sequences form a beta-barrel structure (e.g., made up of anti-parallel beta strands), optionally wherein the beta-barrel structure is as predicted in silico (e.g., using Alphafold2 (Deepmind) software).
9. The nucleic acid of any one of embodiments 1-8, wherein
   (i) a non-native loop sequence replacing VD1 comprises a sequence according to SEQ ID NO: 462 or 466 (e.g., SEQ ID NO: 462);
   (ii) a non-native loop sequence replacing VD2 comprises a sequence according to SEQ ID NO: 463 or 467 (e.g., SEQ II) NO: 463);
   (iii) a non-native loop sequence replacing VD3 comprises a sequence according to SEQ ID NOs 464 or 468 (e.g., SEQ ID NO: 464); and/or
   (iv) a non-native loop sequence replacing VD4 comprises a sequence according to SEQ ID NO: 465 or 469 (e.g., SEQ ID NO: 465), e.g., wherein the modified MOMP polypeptide comprises four non-native loop sequences according to SEQ ID NOs 462, 463, 464 and 465 in place of VD1, VD2, VD3 and VD4, respectively.
10. The nucleic acid of any one of embodiments 1-9, wherein the modified MOMP polypeptide comprises a single amino acid substitution at one or more (e.g., all) positions corresponding to a cysteine residue in a conserved domain sequence of a native *Chlamydia* sp. MOMP polypeptide, optionally wherein the single amino acid substitution is a substitution of cysteine with serine.
11. The nucleic acid of any one of embodiments 1-10, wherein the modified MOMP polypeptide comprises a mutation at one or more (e.g., all) positions corresponding to a glycosylation site, optionally an N-glycosylation site, in a native *Chlamydia* sp. MOMP polypeptide, optionally wherein the mutation is a single amino acid substitution.
12. The nucleic acid of any one of embodiments 1-11, wherein the modified MOMP polypeptide further comprises a secretion signal peptide sequence.
13. The nucleic acid of embodiment 12, wherein the secretion signal peptide sequence is a viral secretion signal peptide sequence, optionally selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, and a smallpox 6 kDa IC protein secretion signal peptide sequence, optionally wherein the secretion signal peptide sequence comprises an amino acid sequence according to one of the SEQ ID NOs in Table 2 or Table 2.1.

14. The nucleic acid of embodiment 13, wherein the secretion signal peptide sequence comprises a secretion signal peptide sequence of HA protein of influenza A virus, e.g., wherein the secretion signal peptide sequence comprises a sequence according to SEQ ID NO: 187 or SEQ ID NO: 188.

15. The nucleic acid of any one of embodiments 1-14, wherein the modified MOMP polypeptide comprises a sequence according to any one of SEQ ID NOs: 486-489 or a sequence that has at least 70% (e.g., at least 90 or 95%) identity thereto, e.g., wherein the modified MOMP polypeptide comprises a sequence according to SEQ ID NO: 486 or a sequence that has at least 70% (e.g., at least 90 or 95%) identity thereto.

16. The nucleic acid of any one of embodiments 1-15, wherein the nucleic acid comprises a nucleotide sequence according to any one of SEQ ID NOs: 551-566 or a sequence that has at least 50% identity thereto, e.g., wherein the nucleic acid comprises a nucleotide sequence according to SEQ ID NO: 551 or a sequence that has at least 50% (e.g., at least 75%) identity thereto.

17. The nucleic acid of any one of embodiments 1-16, wherein the nucleic acid is a messenger RNA (mRNA), optionally wherein
   (i) the mRNA comprises at least one 5' untranslated region (5' UTR), at least one 3' untranslated region (3' UTR), and/or at least one polyadenylation (poly (A)) sequence;
   (ii) the mRNA is unmodified or comprises at least one chemical modification, optionally wherein the mRNA comprises at least one chemical modification, e.g., wherein the chemical modification comprises N1-methylpseudouridine; and/or
   (iii) the mRNA is a self-replicating mRNA or a non-replicating mRNA, e.g., a non-replicating mRNA.

18. The nucleic acid of embodiment 17, wherein the mRNA comprises or consists of (e.g., consisting of) the following structural elements:
   a 5' cap, e.g., a cap with the following structure:

a 5' untranslated region (5' UTR) having the nucleic acid sequence according to SEQ ID NO: 838;
a protein coding region having the nucleic acid sequence according to SEQ ID NO: 213;
a 3' untranslated region (3' UTR) having the nucleic acid sequence according to SEQ ID NO: 839; and
a polyA tail.

19. The nucleic acid of embodiment 18, wherein the mRNA is chemically modified and wherein the chemical modification comprises or consists of (e.g., consists of) N1-methylpseudouridine in place of every uridine.

20. A modified Major Outer Membrane Protein (MOMP) polypeptide having an amino acid sequence comprising two or more conserved domain sequences of a native *Chlamydia* sp. MOMP polypeptide and a non-native loop sequence between the conserved domain sequences.

21. The modified MOMP polypeptide of embodiment 20, wherein the modified MOMP polypeptide does not comprise a native *Chlamydia* sp. MOMP variable domain between the two or more conserved domain sequences.

22. The modified MOMP polypeptide of embodiment 20 or 21, wherein the modified MOMP polypeptide comprises five conserved domain sequences of a native *Chlamydia* sp. MOMP polypeptide, optionally wherein (i) the modified MOMP polypeptide comprises all five full-length conserved domains of a native *Chlamydia* sp. MOMP polypeptide; and/or (ii) the conserved domains of the modified MOMP polypeptide collectively have at least 95% sequence identity to the conserved domains of a native MOMP polypeptide (e.g., serovar E MOMP).

23. The modified MOMP polypeptide of any one of embodiments 20-22, wherein the modified MOMP polypeptide comprises a non-native loop sequence between each of the conserved domain sequences.

24. The modified MOMP polypeptide of embodiment 22, wherein the modified MOMP polypeptide comprises four non-native loop sequences and does not comprise native *Chlamydia* sp. MOMP variable domains between the conserved domain sequences.

25. The modified MOMP polypeptide of any one of embodiments 20-24, wherein the modified MOMP polypeptide does not comprise any native *Chlamydia* sp. MOMP variable domains between any of the conserved domain sequences.

26. The modified MOMP polypeptide of any one of embodiments 20-25, wherein the non-native loop sequence is between 3 and 30 amino acids in length, e.g., between 4 and 20 amino acids in length.

27. The modified MOMP polypeptide of any one of embodiments 20-26, wherein
  (i) a non-native loop sequence replacing VD1 comprises a sequence according to SEQ ID NO: 462 or 466 (e.g., SEQ ID NO: 462);
  (ii) a non-native loop sequence replacing VD2 comprises a sequence according to SEQ ID NO: 463 or 467 (e.g., SEQ ID NO: 463);
  (iii) a non-native loop sequence replacing VD3 comprises a sequence according to SEQ ID NOs 464 or 468 (e.g., SEQ ID NO: 464); and/or
  (iv) a non-native loop sequence replacing VD4 comprises a sequence according to SEQ ID NO: 465 or 469 (e.g., SEQ ID NO: 465), e.g., wherein the modified MOMP polypeptide may comprise four non-native loop sequences according to SEQ ID NOs 462-465 in place of VD1, VD2, VD3 and VD4, respectively.

28. The modified MOMP polypeptide of any one of embodiments 20-27, wherein the modified MOMP polypeptide comprises a single amino acid substitution at one or more (e.g., all) positions corresponding to a cysteine residue in a conserved domain sequence of a native *Chlamydia* sp. MOMP polypeptide, optionally wherein the single amino acid substitution is a substitution of cysteine with serine.

29. The modified MOMP polypeptide of any one of embodiments 20-28, wherein the modified MOMP polypeptide comprises a mutation at one or more (e.g., all) positions corresponding to an N-glycosylation site in a native *Chlamydia* sp. MOMP polypeptide, optionally wherein the mutation is a single amino acid substitution.

30. The modified MOMP polypeptide of any one of embodiments 20-29, wherein the modified MOMP polypeptide comprises a sequence according to any one of SEQ ID NO: 486-489 or a sequence that has at least 70% (e.g., at least 90 or 95%) identity thereto, e.g., wherein the modified MOMP polypeptide comprises a sequence according to SEQ ID NO: 486 or a sequence that has at least 70% (e.g., at least 90 or 95%) identity thereto.

31. A composition comprising the nucleic acid of any one of embodiments 1-19, e.g., wherein the composition is an immunogenic composition.

32. A composition comprising the polypeptide of any one of embodiments 20-30, e.g., wherein the composition is an immunogenic composition.

33. The composition of embodiment 31, wherein the composition further comprises:
  (i) a nucleic acid that comprises a nucleotide sequence encoding a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
  (ii) one or more (e.g., one, two, three, or four) of:
    (a) a nucleic acid that comprises a nucleotide sequence encoding a *Chlamydia* sp. CT443 polypeptide;
    (b) a nucleic acid that comprises a nucleotide sequence encoding a *Chlamydia* sp. CT584 polypeptide;
    (c) a nucleic acid that comprises a nucleotide sequence encoding a *Chlamydia* sp. CT600 polypeptide; and
    (d) a nucleic acid that comprises a nucleotide sequence encoding a *Chlamydia* sp. CT812 polypeptide.

34. The composition of embodiment 33, wherein the composition comprises
  the nucleic acid of (i) and the nucleic acid of (ii)(a);
  the nucleic acid of (i) and the nucleic acid of (ii)(b); or
  the nucleic acid of (i), the nucleic acid of (ii)(a) and the nucleic acid of (ii)(b);
  e.g., wherein the composition comprises the nucleic acid of (i), the nucleic acid of (ii)(a) and the nucleic acid of (ii)(b).

35. The composition of embodiment 33 or 34, wherein one or more nucleic acids is a mRNA, optionally wherein (i) the mRNA comprises at least one 5' untranslated region (5' UTR), at least one 3' untranslated region (3' UTR), and/or at least one polyadenylation (poly (A)) sequence;
(ii) the mRNA is unmodified or comprises at least one chemical modification, optionally wherein the mRNA comprises at least one chemical modification e.g., wherein the chemical modification comprises N1-methylpseudouridine; and/or
(iii) the mRNA is a self-replicating mRNA or a non-replicating mRNA, e.g., a non-replicating mRNA.

36. The composition of any one of embodiments 31 or 33-35, wherein the composition further comprises a lipid nanoparticle (LNP), optionally wherein the nucleic acid is encapsulated in the LNP.

37. The composition of embodiment 32, wherein the composition further comprises:
   (i) a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
   (ii) one or more (e.g., one, two, three or four) of:
      (a) a polypeptide comprising amino acid sequence of a *Chlamydia* sp. CT443 polypeptide;
      (b) a polypeptide comprising amino acid sequence of a *Chlamydia* sp. CT584 polypeptide;
      (c) a polypeptide comprising amino acid sequence of a *Chlamydia* sp. CT600 polypeptide; or
      (d) a polypeptide comprising amino acid sequence of a *Chlamydia* sp. CT812 polypeptide,
      e.g., wherein the composition comprises
         the polypeptide of (i) and the polypeptide of (ii)(a); or
         the polypeptide of (i) and the polypeptide of (ii)(b); or
         the polypeptide of (i), the polypeptide of (ii)(a) and the polypeptide of (ii)(b),
      e.g., wherein the composition comprises the polypeptide of (i), the polypeptide of (ii)(a) and the polypeptide of (ii)(b).

38. The composition of any one of embodiments 33-37, wherein the *Chlamydia* sp. is *Chlamydia* trachomatis.

39. The composition of any one of embodiments 33-38, wherein the chimeric MOMP VD polypeptide comprises conserved domain sequence portions of a native *Chlamydia* sp. MOMP polypeptide flanking each of the two or more MOMP VD sequences.

40. The composition of any one of embodiments 33-39, wherein the chimeric MOMP VD polypeptide comprises MOMP VD sequences of four different serovars, optionally wherein the different serovars are selected from serovars D, E, F or G of *C. trachomatis*.

41. The composition of any one of embodiments 33-40, wherein the chimeric MOMP VD polypeptide comprises:
   (i) two MOMP VD1 sequences of different serovars of the *Chlamydia* sp. and/or
   (ii) two MOMP VD2 sequences of different serovars of the *Chlamydia* sp.; and/or
   (iii) one MOMP VD3 sequence; and/or
   (iv) two MOMP VD4 sequences of different serovars of the *Chlamydia* sp.,
   optionally wherein the different serovars are selected from serovars D, E, F or G of *C. trachomatis*.

42. The composition of any one of embodiments 33-40, wherein the chimeric MOMP VD polypeptide comprises one MOMP VD sequence of serovar D or E of *C. trachomatis* and one MOMP VD sequence of serovar F or G of *C. trachomatis*.

43. The composition of embodiment 41 or 42, wherein the chimeric MOMP VD polypeptide comprises at least one (e.g., four) of (i)-(iv):
   (i) a MOMP VD1 sequence from serovar D and a MOMP VD1 sequence from serovar F, or a MOMP VD1 sequence from serovar E and a MOMP VD1 sequence from serovar F or G (e.g., a MOMP VD1 sequence of serovar E and a MOMP VD1 sequence of serovar G); and/or
   (ii) a MOMP VD2 sequence from serovar E and a MOMP VD2 sequence from serovar F, or a MOMP VD2 sequence from serovar D and a MOMP VD2 sequence from serovar G (e.g., a MOMP VD2 sequence of serovar D and a MOMP VD2 sequence of serovar G); and/or
   (iii) a MOMP VD3 sequence from serovar G or a VD3 sequence from serovar F (e.g., serovar F); and/or
   (iv) a MOMP VD4 sequence from serovar E and a MOMP VD4 sequence from serovar G, or a MOMP VD4 sequence from serovar D and a MOMP VD4 sequence from serovar F (e.g., a MOMP VD4 sequence of serovar D and a MOMP VD4 sequence of serovar F),
   wherein the serovars D, E, F or G are of *C. trachomatis*.

44. The composition of embodiment 43, wherein the chimeric MOMP VD polypeptide comprises:
   (i) a MOMP VD1 sequence from serovar D and a MOMP VD1 sequence from serovar F, a MOMP VD2 sequence from serovar E and a MOMP VD2 sequence from serovar F, a MOMP VD3 sequence from serovar G, a MOMP VD4 sequence from serovar E and a MOMP VD4 sequence from serovar G; or
   (ii) a MOMP VD1 sequence from serovar E and a MOMP VD1 sequence from serovar F, a MOMP VD2 sequence from serovar D and a MOMP VD2 sequence from serovar G, a MOMP VD3 sequence from serovar F, a MOMP VD4 sequence from serovar D and a MOMP VD4 sequence from serovar F,
   wherein the serovars D, E, F or G are of *C. trachomatis*,
   e.g., wherein the chimeric MOMP VD polypeptide comprises MOMP VD sequences according to (ii).

45. The composition of any one of embodiments 39-44, wherein the conserved domain sequence portions are portions of conserved domain sequences of a native *Chlamydia* sp. MOMP polypeptide flanking the VD in its native *Chlamydia* sp. MOMP polypeptide.

46. The composition of any one of embodiments 39-45, wherein each conserved domain sequence portion comprises between 3 and 30 amino acid residues of a conserved domain sequence of a native *Chlamydia* sp. MOMP polypeptide, wherein the between 3 and 30 amino acid residues are immediately adjacent to the VD sequence in its native *Chlamydia* sp. MOMP polypeptide.

47. The composition of any one of embodiments 33-36 or 38-46, wherein the composition comprises the nucleic acid that comprises a nucleotide sequence encoding a chimeric *Chlamydia* sp. MOMP VD polypeptide and wherein the chimeric MOMP VD polypeptide comprises a secretion signal peptide sequence.

48. The composition of embodiment 47, wherein the secretion signal peptide sequence is a viral secretion signal peptide sequence, optionally selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, and a smallpox 6 kDa IC protein secretion signal peptide sequence, optionally wherein the secretion signal peptide sequence comprises an amino acid sequence according to any one of the SEQ ID NOs in Table 2 or Table 2.1.

49. The composition of embodiment 48, wherein the secretion signal peptide sequence comprises a secretion signal peptide sequence of HA protein of influenza A virus, e.g., wherein the secretion signal peptide sequence comprises a sequence according to SEQ ID NO: 187 or SEQ ID NO: 188.

50. The composition of any one of embodiments 33-49, wherein the chimeric MOMP VD polypeptide comprises a single amino acid substitution at one or more (e.g., all) positions corresponding to a cysteine residue in a conserved domain sequence of a native *Chlamydia* sp. MOMP polypeptide, optionally wherein the single amino acid substitution is a substitution of cysteine with serine.

51. The composition of any one of embodiments 33-50, wherein the chimeric MOMP VD polypeptide comprises a mutation at one or more (e.g., all) positions corresponding to a glycosylation site, optionally an N-glycosylation site, in a native *Chlamydia* sp. MOMP polypeptide, optionally wherein the mutation is a single amino acid substitution.

52. The composition of embodiment 51, wherein the chimeric MOMP VD polypeptide comprises a single amino acid substitution at each of the amino acid residues corresponding to position 9 of SEQ ID NO: 9 (e.g., N to A substitution), position 11 of SEQ ID NO: 17 (e.g., T to A substitution), position 17 of SEQ ID NO: 6 (e.g., S to A substitution), positions 4 and 21 of SEQ ID NO: 18 (e.g., N to A and S to A substitutions, respectively), position 14 of SEQ ID NO: 8 (e.g., a T to A substitution) and position 14 in SEQ ID NO: 16 (e.g., T to A substitution).

53. The composition of any one of embodiments 33-52, wherein the chimeric MOMP VD polypeptide comprises a sequence according to any one of SEQ ID NO: 490-505 or a sequence that has at least 70% (e.g., at least 90 or 95%) identity thereto, e.g., wherein the chimeric MOMP VD polypeptide comprises a sequence according to SEQ ID NO: 503 or a sequence that has at least 70% (e.g., at least 90 or 95%) identity thereto.

54. The composition of any one of embodiments 33-36 or 38-53, wherein the composition comprises the nucleic acid that comprises a nucleotide sequence encoding a chimeric *Chlamydia* sp. MOMP VD polypeptide and wherein the nucleic acid comprises a nucleotide sequence according to SEQ ID NO: 567-630 or a sequence that has at least 50% (e.g., at least 75%) identity thereto, e.g., wherein the nucleic acid comprises a nucleotide sequence according to SEQ ID NO: 617 or a sequence that has at least 50% (e.g., at least 75%) identity thereto.

55. The composition of any one of embodiments 33-36 or 38-54, wherein the composition comprises one or more nucleic acids of (ii)(a)-(d) and wherein the *Chlamydia* sp. CT443 polypeptide, the *Chlamydia* sp. CT584 polypeptide, the *Chlamydia* sp. CT600 polypeptide and the *Chlamydia* sp. CT812 polypeptide comprise a secretion signal peptide sequence.

56. The composition of embodiment 55, wherein the secretion signal peptide sequence is a viral secretion signal peptide sequence, optionally selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, and a smallpox 6 kDa IC protein secretion signal peptide sequence, optionally wherein the secretion signal peptide sequence comprises an amino acid sequence according to one of the SEQ ID NOs in Table 2 or Table 2.1.

57. The composition of embodiment 56, wherein the secretion signal peptide sequence comprises a secretion signal peptide sequence of HA protein of influenza A virus, e.g., wherein the secretion signal peptide sequence comprises a sequence according to SEQ ID NO: 187 or SEQ ID NO: 188.

58. The composition of any one of embodiments 55-57, wherein one or more of the *Chlamydia* sp. CT443 polypeptide, the *Chlamydia* sp. CT584 polypeptide, the *Chlamydia* sp. CT600 polypeptide or the *Chlamydia* sp. CT812 polypeptide comprises a heterologous transmembrane domain.

59. The composition of embodiment 58, wherein the transmembrane domain sequence is selected from the group consisting of: an influenza hemagglutinin (HA) transmembrane domain sequence, a SARS CoV-2 spike transmembrane domain sequence, a VZV gB transmembrane domain sequence, a VZV gE transmembrane domain sequence, a VZV gI transmembrane domain sequence, a VZV gK transmembrane domain sequence, a measles F-protein transmembrane domain sequence, a rubella E1 protein transmembrane domain sequence, a rubella E2 protein transmembrane domain sequence, a mumps F-protein transmembrane domain sequence and an Ebola GP protein transmembrane domain sequence, optionally wherein the transmembrane domain comprises an amino acid sequence according to one of the SEQ ID NOs in Table 3.

60. The composition of embodiment 58 or 59, wherein the transmembrane domain comprises the sequence of a transmembrane domain of HA protein of influenza A virus, e.g., wherein the transmembrane domain comprises a sequence according to SEQ ID NO: 813 or SEQ ID NO: 814.
61. The composition of any one of embodiments 33-60, wherein one or more of the *Chlamydia* sp. CT443 polypeptide, the *Chlamydia* sp. CT584 polypeptide, the *Chlamydia* sp. CT600 polypeptide or the *Chlamydia* sp. CT812 polypeptide comprises a single amino acid substitution at one or more (e.g., all) positions corresponding to a cysteine residue in the respective native *Chlamydia* sp. polypeptide, optionally wherein the single amino acid substitution is a substitution of cysteine with serine.
62. The composition of any one of embodiments 33-61, wherein one or more of the *Chlamydia* sp. CT443 polypeptide, the *Chlamydia* sp. CT584 polypeptide, the *Chlamydia* sp. CT600 polypeptide or the *Chlamydia* sp. CT812 polypeptide comprises a mutation at one or more (e.g., all) positions corresponding to an N-glycosylation site in the respective native *Chlamydia* sp. polypeptide, optionally wherein the mutation is a single amino acid substitution.

63. The composition of embodiment 62, wherein the *Chlamydia* sp. CT584 polypeptide comprises a single amino acid substitution at a position corresponding to residue 11 of SEQ ID NO: 509 (e.g., a N to Q substitution).

64. The composition of any one of embodiments 33-63, wherein
   (a) the *Chlamydia* sp. CT443 polypeptide comprises a sequence according to SEQ ID NO: 507-508 or a sequence that has at least 70% (e.g., at least 90 or 95%) identity thereto, e.g., wherein the *Chlamydia* sp. CT443 polypeptide comprises a sequence according to SEQ ID NO: 507 or a sequence that has at least 70% (e.g., at least 90 or 95%) identity thereto;
   (b) the *Chlamydia* sp. CT584 polypeptide comprises a sequence according to any one of SEQ ID NO: 509-512 or a sequence that has at least 70% (e.g., at least 90 or 95%) identity thereto, e.g., wherein the *Chlamydia* sp. CT584 polypeptide comprises a sequence according to any one of SEQ ID NO: 510 or a sequence that has at least 70% (e.g., at least 90 or 95%) identity thereto;
   (c) the *Chlamydia* sp. CT600 polypeptide comprises a sequence according to any one of SEQ ID NO: 513-514 or a sequence that has at least 70% (e.g., at least 90 or 95%) identity thereto; and/or
   (d) the *Chlamydia* sp. CT812 polypeptide comprises a sequence according to any one of SEQ ID NO: 515-535 or a sequence that has at least 70% (e.g., at least 90 or 95%) identity thereto.

65. The composition of any one of embodiments 33-36 or 38-64, wherein the composition comprises:
   (1) the chimeric MOMP VD polypeptide comprises a sequence according to any one of SEQ ID NO: 490-505 (e.g., SEQ ID NO: 503) or a sequence that has at least 70% (e.g., at least 90 or 95%) identity thereto;
   (2) the nucleic acid that comprises a nucleotide sequence encoding a chimeric *Chlamydia* sp. MOMP VD polypeptide comprises a nucleotide sequence according to SEQ ID NO: 567-630 (e.g., SEQ ID NO: 617) or a sequence that has at least 50% identity thereto;
   (3) the *Chlamydia* sp. CT443 polypeptide comprises a sequence according to SEQ ID NO: 507 or a sequence that has at least 70% (e.g., at least 90 or 95%) identity thereto;
   (4) the nucleic acid comprising a nucleotide sequence encoding the *Chlamydia* sp. CT443 polypeptide comprises a nucleotide sequence according to any one of SEQ ID NO: 707-710 (e.g., SEQ ID NO: 707) or a sequence that has at least 50% (e.g., at least 75%) identity thereto;
   (5) the *Chlamydia* sp. CT584 polypeptide comprises a sequence according to any one of SEQ ID NO: 509-512 (e.g., SEQ ID NO: 510) or a sequence that has at least 70% (e.g., at least 90 or 95%) identity thereto;
   (6) the nucleic acid comprising a nucleotide sequence encoding the *Chlamydia* sp. CT584 polypeptide comprises a nucleotide sequence according to any one of SEQ ID NO: 711-718 (e.g., SEQ ID NO: 715) or a sequence that has at least 50% (e.g., at least 75%) identity thereto;
   (7) the *Chlamydia* sp. CT600 polypeptide comprises a sequence according to any one of SEQ ID NO: 513-514 or a sequence that has at least 70% (e.g., at least 90 or 95%) identity thereto; and/or
   (8) the nucleic acid comprising a nucleotide sequence encoding the *Chlamydia* sp. CT600 polypeptide comprises a nucleotide sequence according to any one of SEQ ID NO: 719-722 or a sequence that has at least 50% (e.g., at least 75%) identity thereto;
   (9) the *Chlamydia* sp. CT812 polypeptide comprises a sequence according to any one of SEQ ID NO: 515-535 or a sequence that has at least 70% (e.g., at least 90 or 95%) identity thereto; and/or
   (10) the nucleic acid comprising a nucleotide sequence encoding the *Chlamydia* sp. CT812 polypeptide comprises a nucleotide sequence according to any one of SEQ ID NO: 723-762 or a sequence that has at least 50% (e.g., at least 75%) identity thereto;

optionally wherein:

the nucleic acids of (ii)(a), wherein the nucleic acid of (ii)(a) comprises a nucleotide sequence according to SEQ ID NO: 707 or a sequence that has at least 50%, (at least 75%) identity thereto, and/or the nucleic acid of (ii)(b), wherein the nucleic acid of (ii)(b) comprises a nucleotide sequence according to SEQ ID NO: 715 or a sequence that has at least 50%, (at least 75%) identity thereto.

66. The composition of any one of embodiments 33-36 or 38-65, wherein nucleic acid of (ii)(a) is a mRNA and the mRNA comprises or consists of (e.g., consists of) the following structural elements:

a 5' cap, e.g., a 5' cap with the following structure:

[Chemical structure of 5' cap]

a 5' untranslated region (5' UTR) having the nucleic acid sequence according to SEQ ID NO: 838;
a protein coding region having the nucleic acid sequence according to SEQ ID NO: 369;
a 3' untranslated region (3' UTR) having the nucleic acid sequence according to SEQ ID NO:839; and
a polyA tail.

67. The composition of any one of embodiments 33-36 or 38-66, wherein nucleic acid of (ii)(b) is a mRNA and the mRNA comprises or consists of (e.g., consists of) the following structural elements:
a 5' cap, e.g., a 5' cap with the following structure:

[Chemical structure of 5' cap]

a 5' untranslated region (5' UTR) having the nucleic acid sequence according to SEQ ID NO: 838;
a protein coding region having the nucleic acid sequence according to SEQ ID NO: 377;
a 3' untranslated region (3' UTR) having the nucleic acid sequence according to SEQ ID NO: 839; and
a polyA tail.

68. The composition of embodiment 54, wherein the nucleic acid comprising a nucleotide sequence encoding the chimeric *Chlamydia* sp. MOMP VD polypeptide is a mRNA and the mRNA comprises or consists of (e.g., consists of) the following structural elements:
a 5' cap, e.g., a 5' cap with the following structure:

[Chemical structure of 5' cap]

a 5' untranslated region (5' UTR) having the nucleic acid sequence according to SEQ ID NO: 838;
a protein coding region having the nucleic acid sequence according to SEQ ID NO: 870;
a 3' untranslated region (3' UTR) having the nucleic acid sequence according to SEQ ID NO: 839; and
a polyA tail.

69. The composition of any one of embodiments 33-36 or 38-68, wherein the composition comprises:
   (1) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);
      the nucleic acid (e.g., mRNA) comprising a nucleotide sequence encoding the chimeric *Chlamydia* sp. MOMP VD polypeptide, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68); and
      the nucleic acid (e.g., mRNA) comprising a nucleotide sequence encoding the *Chlamydia* sp. CT443 polypeptide, wherein the nucleic acid comprises a nucleotide sequence according to SEQ ID NO: 707 or a sequence that has at least 50% (e.g., at least 75%) identity thereto (e.g., wherein the nucleic acid is the mRNA of embodiment 67); or
   (2) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);
      the nucleic acid (e.g., mRNA) comprising a nucleotide sequence encoding the chimeric *Chlamydia* sp. MOMP VD polypeptide, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68); and
      the nucleic acid (e.g., mRNA) comprising a nucleotide sequence encoding the *Chlamydia* sp. CT584 polypeptide, wherein the nucleic acid comprises a nucleotide sequence according to SEQ ID NO: 715 or a sequence that has at least 50% (e.g., at least 75%) identity thereto (e.g., wherein the nucleic acid is the mRNA of embodiment 67); or
   (3) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);
      the nucleic acid (e.g., mRNA) comprising a nucleotide sequence encoding the chimeric *Chlamydia* sp. MOMP VD polypeptide, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68);
      the nucleic acid (e.g., mRNA) comprising a nucleotide sequence encoding the *Chlamydia* sp. CT443 polypeptide, wherein the nucleic acid comprises a nucleotide sequence according to SEQ ID NO: 707 or a sequence that has at least 50% (e.g., at least 75%) identity thereto (e.g., wherein the nucleic acid is the mRNA of embodiment 67); and
      the nucleic acid (e.g., mRNA) comprising a nucleotide sequence encoding the *Chlamydia* sp. CT584 polypeptide, wherein the nucleic acid comprises a nucleotide sequence according to SEQ ID NO: 715 or a sequence that has at least 50% (e.g., at least 75%) identity thereto (e.g., wherein the nucleic acid is the mRNA of embodiment 67); or
   (4) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;
      the nucleic acid (e.g., mRNA) comprising a nucleotide sequence encoding the chimeric *Chlamydia* sp. MOMP VD polypeptide, wherein the chimeric MOMP VD polypeptide comprises a sequence according to SEQ ID NO: 503 or a sequence that has at least 75% (e.g., at least 90 or 95%) identity thereto; and
      the nucleic acid (e.g., mRNA) comprising a nucleotide sequence encoding the *Chlamydia* sp. CT443 polypeptide, wherein the encoding the *Chlamydia* sp. CT443 polypeptide comprises a sequence according to SEQ ID NO: 507 or a sequence that has at least 75% (e.g., at least 90 or 95%) identity thereto; or
   (5) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;
      the nucleic acid (e.g., mRNA) comprising a nucleotide sequence encoding the chimeric *Chlamydia* sp. MOMP VD polypeptide, wherein the chimeric MOMP VD polypeptide comprises a sequence according to SEQ ID NO: 503 or a sequence that has at least 75% (e.g., at least 90 or 95%) identity thereto; and
      the nucleic acid comprising a nucleotide sequence encoding the *Chlamydia* sp. CT584 polypeptide, wherein the *Chlamydia* sp. CT584 polypeptide comprises a sequence according to SEQ ID NO: 510 or a sequence that has at least 75% (e.g., at least 90 or 95%) identity thereto; or
   (6) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;
      the nucleic acid (e.g., mRNA) comprising a nucleotide sequence encoding the chimeric *Chlamydia* sp. MOMP VD polypeptide, wherein the chimeric MOMP VD polypeptide comprises a sequence according to SEQ ID NO: 503 or a sequence that has at least 75% (e.g., at least 90 or 95%) identity thereto;
      the nucleic acid (e.g., mRNA) comprising a nucleotide sequence encoding the *Chlamydia* sp. CT443 polypeptide, wherein the encoding the *Chlamydia* sp. CT443 polypeptide comprises a sequence according to SEQ ID NO: 507 or a sequence that has at least 75% (e.g., at least 90 or 95%) identity thereto; and
      the nucleic acid comprising a nucleotide sequence encoding the *Chlamydia* sp. CT584 polypeptide, wherein the *Chlamydia* sp. CT584 polypeptide comprises a sequence according to SEQ ID NO: 510 or a sequence that has at least 75% (e.g., at least 90 or 95%) identity thereto,
    e.g., wherein the composition comprises the nucleic acids as defined in (3) or the nucleic acids as defined in (6).
70. The composition of any one of embodiments 32 or 37-64, wherein the composition comprises:
(1) the modified MOMP polypeptide that comprises a sequence according to SEQ ID NO: 486 or a sequence that has at least 70% (e.g., at least 90 or 95%) identity thereto;
    the chimeric *Chlamydia* sp. MOMP VD polypeptide that comprises a sequence according to SEQ ID NO: 503 or a sequence that has at least 75% (e.g., at least 90 or 95%) identity thereto; and
    the *Chlamydia* sp. CT443 polypeptide that comprises a sequence according to SEQ ID NO: 507 or a sequence that has at least 75% (e.g., at least 90 or 95%) identity thereto; or
(2) the modified MOMP polypeptide that comprises a sequence according to SEQ ID NO: 486 or a sequence that has at least 70% (e.g., at least 90 or 95%) identity thereto;
    the chimeric *Chlamydia* sp. MOMP VD polypeptide that comprises a sequence according to SEQ ID NO: 503 or a sequence that has at least 75% (e.g., at least 90 or 95%) identity thereto; and
    the *Chlamydia* sp. CT584 polypeptide that comprises a sequence according to SEQ ID NO: 510 or a sequence that has at least 75% (e.g., at least 90 or 95%) identity thereto; or
(3) the modified MOMP polypeptide that comprises a sequence according to SEQ ID NO: 486 or a sequence that has at least 70% (e.g., at least 90 or 95%) identity thereto;
    the chimeric *Chlamydia* sp. MOMP VD polypeptide that comprises a sequence according to SEQ ID NO: 503 or a sequence that has at least 75% (e.g., at least 90 or 95%) identity thereto;
    the *Chlamydia* sp. CT443 polypeptide that comprises a sequence according to SEQ ID NO: 507 or a sequence that has at least 75% (e.g., at least 90 or 95%) identity thereto; and
    the *Chlamydia* sp. CT584 polypeptide that comprises a sequence according to SEQ ID NO: 510 or a sequence that has at least 75% (e.g., at least 90 or 95%) identity thereto,
    e.g., wherein the composition comprises the polypeptides as defined in (3).
71. A combination comprising a nucleic acid of any one of embodiments 1-19 and:
(i) a nucleic acid that comprises a nucleotide sequence encoding a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
(ii) one or more (e.g., one, two, three or four) of:
    (a) a nucleic acid that comprises a nucleotide sequence encoding a *Chlamydia* sp. CT443 polypeptide;
    (b) a nucleic acid that comprises a nucleotide sequence encoding a *Chlamydia* sp. CT584 polypeptide;
    (c) a nucleic acid that comprises a nucleotide sequence encoding a *Chlamydia* sp. CT600 polypeptide; or
    (d) a nucleic acid that comprises a nucleotide sequence encoding a *Chlamydia* sp. CT812 polypeptide.
72. The combination of embodiment 71, wherein the composition comprises
    the nucleic acid of (i) and the nucleic acid of (ii)(a);
    the nucleic acid of (i) and the nucleic acid of (ii)(b); or
    the nucleic acid of (i), the nucleic acid of (ii)(a) and the nucleic acid of (ii)(b),
    e.g., wherein the composition comprises the nucleic acid of (i), the nucleic acid of (ii)(a) and the nucleic acid of (ii)(b),
    optionally wherein the nucleic acids are as defined in embodiment 69.
73. A combination comprising a polypeptide of any one of embodiments 20-30 and:
(i) a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
(ii) one or more (e.g., one, two, three or four) of:
    (a) a polypeptide comprising amino acid sequence of a *Chlamydia* sp. CT443 polypeptide;
    (b) a polypeptide comprising amino acid sequence of a *Chlamydia* sp. CT584 polypeptide;
    (c) a polypeptide comprising amino acid sequence of a *Chlamydia* sp. CT600 polypeptide; or
    (d) a polypeptide comprising amino acid sequence of a *Chlamydia* sp. CT812 polypeptide.
74. The combination of embodiment 73, wherein the composition comprises
    the polypeptide of (i) and the polypeptide of (ii)(a);
    the polypeptide of (i) and the polypeptide of (ii)(b); or
    the polypeptide of (i), the polypeptide of (ii)(a) and the polypeptide of (ii)(b),
    e.g., wherein the composition comprises the polypeptide of (i), the polypeptide of (ii)(a) and the polypeptide of (ii)(b),
    optionally wherein the polypeptides are as defined in embodiment 70.
75. The combination of embodiment 71 or 72, wherein the nucleic acids are present in the same composition or in two or more separate compositions.
76. The combination of embodiment 73 or 74, wherein the polypeptides are present in the same composition or in two or more separate compositions.
77. The composition of embodiment 37, wherein the composition further comprises an adjuvant.
78. The composition of embodiment 36, wherein the LNP comprises at least one cationic lipid, optionally wherein:
    (i) the cationic lipid is selected from the group consisting of OF-02, cKK-E10, OF-Deg-Lin, GL-HEPES-E3-E10-DS-3-E18-1, GL-HEPES-E3-E12-DS-4-E10, GL-HEPES-E3-E12-DS-3-E14, SM-102, ALC-0315, ATX-126, and IM-001 (e.g., GL-HEPES-E3-E12-DS-4-E10 or TM-001); and/or
    (ii) the LNP further comprises a polyethylene glycol (PEG) conjugated (PEGylated) lipid, a cholesterol-based lipid, and a helper lipid, optionally wherein the (PEGylated) lipid is DMG-PEG2000 or ALC-0159 (e.g., DMG-PEG2000);
    the cholesterol-based lipid is cholesterol; and/or
    the helper lipid is DOPE or DSPC; and/or (iii) the LNP comprises:
(1) OF-02 at a molar ratio of 40%; DMG-PEG2000 at a molar ratio of 1.5%; cholesterol at a molar ratio of 28.5%; and DOPE at a molar ratio of 30%;
(2) cKK-E10 at a molar ratio of 40%; DMG-PEG2000 at a molar ratio of 1.5%; cholesterol at a molar ratio of 28.5%; and DOPE at a molar ratio of 30%;
(3) GL-HEPES-E3-E10-DS-3-E18-1 at a molar ratio of 40%; DMG-PEG2000 at a molar ratio of 1.5%; cholesterol at a molar ratio of 28.5%; and DOPE at a molar ratio of 30%;
(4) GL-HEPES-E3-E12-DS-4-E10 at a molar ratio of 40%; DMG-PEG2000 at a molar ratio of 1.5%; cholesterol at a molar ratio of 28.5%; and DOPE at a molar ratio of 30%;
(5) GL-HEPES-E3-E12-DS-3-E14 at a molar ratio of 40%; DMG-PEG2000 at a molar ratio of 1.5%; cholesterol at a molar ratio of 28.5%; and DOPE at a molar ratio of 30%;
(6) DLin-MC3-DMA (MC3) at a molar ratio of 50%; DMG-PEG2000 at a molar ratio of 1.5%; cholesterol at a molar ratio of 38.5%; and DSPC at a molar ratio of 10%; or
(7) IM-001 at a molar ratio of 40%; DMG-PEG2000 at a molar ratio of 1.5%; cholesterol at a molar ratio of 28.5%; and DOPE at a molar ratio of 30%,
(8) SM-102 at a molar ratio of 50%, DMG-PEG2000 at a molar ratio of 1.5%, cholesterol at a molar ratio of 38.5%, and DSPC at a molar ratio of 10%;
(9) ALC-0315 at a molar ratio of 46.3%, ALC-0159 at a molar ratio of 1.6%, cholesterol at a molar ratio of 42.7%, and DSPC at a molar ratio of 9.4%;
(10) ALC-0315 at a molar ratio of 47.4%; ALC-0159 at a molar ratio of 1.7%, cholesterol at a molar ratio of 40.9%; and DSPC at a molar ratio of 10%; or
(11) ATX-126 a molar ratio of 50%; DMG-PEG2000 at a molar ratio of 1.5%, cholesterol at a molar ratio of 38.5%, and DSPC at a molar ratio of 10%.
e.g., wherein the LNP is as defined in (1), (2), (4) or (7), e.g., wherein the LNP is as defined in (4) or (7).

79. The nucleic acid of any one of embodiments 1-19, the modified MOMP polypeptide of any one of embodiments 20-30, the composition of any one of embodiments 31-70, 77 or 78, or the combination of any one of embodiments 71-76, for use as a medicament.

80. The nucleic acid of any one of embodiments 1-19, the modified MOMP polypeptide of any one of embodiments 20-30, the composition of any one of embodiments 31-70, 77 or 78, or the combination of any one of embodiments 71-76, for use in treating or preventing a *Chlamydia* sp. infection, e.g., wherein the infection is a *C. trachomatis* infection.

81. The nucleic acid, the modified MOMP polypeptide, the composition, or the combination, for use according to embodiment 80, wherein the infection is a genital infection.

82. A vaccine comprising the nucleic acid of any one of embodiments 1-19, the modified MOMP polypeptide of any one of embodiments 20-30, the composition of any one of embodiments 31-70, 77 or 78, or the combination of any one of embodiments 71-76.

83. A nucleic acid that comprises a nucleotide sequence encoding a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.

84. The nucleic acid of embodiment 83, wherein the *Chlamydia* sp. is *Chlamydia* trachomatis.

85. The nucleic acid of embodiment 83 or 84, wherein the chimeric MOMP VD polypeptide comprises conserved domain sequence portions of a native *Chlamydia* sp. MOMP polypeptide flanking each of the two or more MOMP VD sequences.

86. The nucleic acid of any one of embodiments 83-85, wherein the chimeric MOMP VD polypeptide comprises MOMP VD sequences of four different serovars, optionally wherein the different serovars are selected from serovars D, E, F or G of *C. trachomatis*.

87. The nucleic acid of any one of embodiments 83-86, wherein the chimeric MOMP VD polypeptide comprises:
(i) two MOMP VD1 sequences of different serovars of the *Chlamydia* sp. and/or
(ii) two MOMP VD2 sequences of different serovars of the *Chlamydia* sp.; and/or
(iii) one MOMP VD3 sequence; and/or
(iv) two MOMP VD4 sequences of different serovars of the *Chlamydia* sp.,
optionally wherein the different serovars are selected from serovars D, E, F, or G of *C. trachomatis*.

88. The nucleic acid of any one of embodiments 83-87, wherein the chimeric MOMP VD polypeptide comprises one MOMP VD sequence of serovar D or E of *C. trachomatis* and one MOMP VD sequence of serovar F or G of *C. trachomatis*.

89. The nucleic acid of embodiment 87 or 88, wherein the chimeric MOMP VD polypeptide comprises at least one (e.g., four) of (i)-(iv):
(i) a MOMP VD1 sequence from serovar D and a MOMP VD1 sequence from serovar F, or a MOMP VD1 sequence from serovar E and a MOMP VD1 sequence from serovar F or G (e.g., a MOMP VD1 sequence of serovar E and a MOMP VD1 sequence of serovar G); and/or
(ii) a MOMP VD2 sequence from serovar E and a MOMP VD2 sequence from serovar F, or a MOMP VD2 sequence from serovar D and a MOMP VD2 sequence from serovar G (e.g., a MOMP VD2 sequence of serovar D and a MOMP VD2 sequence of serovar G); and/or
(iii) a MOMP VD3 sequence from serovar G or a VD3 sequence from serovar F (e.g., serovar F); and/or
(iv) a MOMP VD4 sequence from serovar E and a MOMP VD4 sequence from serovar G, or a MOMP VD4 sequence from serovar D and a MOMP VD4 sequence from serovar F (e.g., a MOMP VD4 sequence of serovar D and a MOMP VD4 sequence of serovar F),
wherein the serovars D, E, F or G are of *C. trachomatis*.

90. The nucleic acid of embodiment 89, wherein the chimeric MOMP VD polypeptide comprises:
(i) a MOMP VD1 sequence from serovar D and a MOMP VD1 sequence from serovar F, a MOMP VD2 sequence from serovar E and a MOMP VD2 sequence from serovar F, a MOMP VD3 sequence from serovar G, a MOMP VD4 sequence from serovar E and a MOMP VD4 sequence from serovar G; or (ii) a MOMP VD1 sequence from serovar E and a MOMP VD1 sequence from serovar F, a MOMP VD2 sequence from serovar D and a MOMP VD2 sequence from serovar G, a MOMP VD3 sequence from serovar F, a MOMP VD4 sequence from serovar D and a MOMP VD4 sequence from serovar F, wherein the serovars D, E, F or G are of *C. trachomatis*.

91. The nucleic acid of embodiment 90, wherein the chimeric MOMP VD polypeptide comprises MOMP VD sequences according to (ii).

92. The nucleic acid of any one of embodiments 85-91, wherein the conserved domain sequence portions are portions of conserved domain sequences of a native *Chlamydia* sp. MOMP polypeptide flanking the VD in its native *Chlamydia* sp. MOMP polypeptide.

93. The nucleic acid of any one of embodiments 85-92, wherein each conserved domain sequence portion comprises between 3 and 30 amino acid residues of a conserved domain sequence of a native *Chlamydia* sp. MOMP polypeptide, wherein the between 3 and 30 amino acid residues are immediately adjacent to the VD sequence in its native *Chlamydia* sp. MOMP polypeptide.

94. The nucleic acid of any one of embodiments 83-93, wherein the chimeric *Chlamydia* sp. MOMP VD polypeptide comprises a secretion signal peptide sequence.

95. The nucleic acid of embodiment 94, wherein the secretion signal peptide sequence is a viral secretion signal peptide sequence, optionally selected from the group consisting of: an influenza hemagglutinin (HA) secretion signal peptide sequence, a SARS CoV-2 spike secretion signal peptide sequence, a VZV gB secretion signal peptide sequence, a VZV gE secretion signal peptide sequence, a VZV gI secretion signal peptide sequence, a VZV gK secretion signal peptide sequence, a measles F-protein secretion signal peptide sequence, a rubella E1 protein secretion signal peptide sequence, a rubella E2 protein secretion signal peptide sequence, a mumps F-protein secretion signal peptide sequence, an Ebola GP protein secretion signal peptide sequence, and a smallpox 6 kDa IC protein secretion signal peptide sequence, optionally wherein the secretion signal peptide sequence comprises an amino acid sequence according to any one of the SEQ ID NOs in Table 2 or Table 2.1.

96. The nucleic acid of embodiment 95, wherein the secretion signal peptide sequence comprises a secretion signal peptide sequence of HA protein of influenza A virus, e.g., wherein the secretion signal peptide sequence comprises a sequence according to SEQ ID NO: 187 or SEQ ID NO: 188.

97. The nucleic acid of any one of embodiments 83-96, wherein the chimeric MOMP VD polypeptide comprises a single amino acid substitution at one or more (e.g., all) positions corresponding to a cysteine residue in a conserved domain sequence of a native *Chlamydia* sp. MOMP polypeptide, optionally wherein the single amino acid substitution is a substitution of cysteine with serine.

98. The nucleic acid of any one of embodiments 83-97, wherein the chimeric MOMP VD polypeptide comprises a mutation at one or more (e.g., all) positions corresponding to a glycosylation site, optionally an N-glycosylation site, in a native *Chlamydia* sp. MOMP polypeptide, optionally wherein the mutation is a single amino acid substitution.

99. The nucleic acid of embodiment 98, wherein chimeric MOMP VD polypeptide comprises a single amino acid substitution at each of the amino acid residues corresponding to position 9 of SEQ ID NO: 9 (e.g., N to A substitution), position 11 of SEQ ID NO: 17 (e.g., T to A substitution), position 17 of SEQ ID NO: 6 (e.g., S to A substitution), positions 4 and 21 of SEQ ID NO: 18 (e.g., N to A and S to A substitutions, respectively), position 14 of SEQ ID NO: 8 (e.g., a T to A substitution) and position 14 in SEQ ID NO: 16 (e.g., T to A substitution)

100. The nucleic acid of any one of embodiments 83-99, wherein the chimeric MOMP VD polypeptide comprises a sequence according to any one of SEQ ID NO: 490-505 or a sequence that has at least 70% (e.g., at least 90 or 95%) identity thereto, e.g., wherein the chimeric MOMP VD polypeptide comprises a sequence according to SEQ ID NO: 503 or a sequence that has at least 70% (e.g., at least 90 or 95%) identity thereto.

101. The nucleic acid of any one of embodiments 83-100, wherein the nucleic acid comprises a nucleotide sequence according to SEQ ID NO: 567-630 or a sequence that has at least 50% (e.g., at least 75%) identity thereto, e.g., wherein the nucleic acid comprises a nucleotide sequence according to SEQ ID NO: 617 or a sequence that has at least 50% (e.g., at least 75%) identity thereto.

102. The nucleic acid of any one of embodiments 83-101, wherein the nucleic acid is a messenger RNA (mRNA), optionally wherein (i) the mRNA comprises at least one 5' untranslated region (5' UTR), at least one 3' untranslated region (3' UTR), and/or at least one polyadenylation (poly (A)) sequence;

(ii) the mRNA is unmodified or comprises at least one chemical modification, optionally wherein the mRNA comprises at least one chemical modification, e.g., wherein the chemical modification comprises N1-methylpseudouridine; and/or (iii) the mRNA is a self-replicating mRNA or a non-replicating mRNA, e.g., a non-replicating mRNA.

103. The nucleic acid of embodiment 102, wherein the mRNA comprises or consists of (e.g., consists of) the following structural elements:

a 5' cap, e.g., a 5' cap with the following structure:

a 5' untranslated region (5' UTR) having the nucleic acid sequence according to SEQ ID NO: 838;
a protein coding region having the nucleic acid sequence according to SEQ ID NO: 870;
a 3' untranslated region (3' UTR) having the nucleic acid sequence according to SEQ ID NO: 839; and
a polyA tail.

104. The nucleic acid of embodiment 103, wherein the mRNA is chemically modified and wherein the chemical modification comprises or consists of (e.g., consists of) N1-methylpseudouridine in place of every uridine.

105. A chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.

106. The chimeric MOMP VD polypeptide of embodiment 105, wherein the *Chlamydia* sp. is *Chlamydia trachomatis*.

107. The chimeric MOMP VD polypeptide of embodiments 105 or 106, wherein the chimeric MOMP VD polypeptide comprises conserved domain sequence portions of a native *Chlamydia* sp. MOMP polypeptide flanking each of the two or more MOMP VD sequences.

108. The chimeric MOMP VD polypeptide of any one of embodiments 105-107, wherein the chimeric MOMP VD polypeptide comprises MOMP VD sequences of four different serovars, optionally wherein the different serovars are selected from serovars D, E, F or G of *C. trachomatis*.

109. The chimeric MOMP VD polypeptide of any one of embodiments 105-108, wherein the chimeric MOMP VD polypeptide comprises:
(i) two MOMP VD1 sequences of different serovars of the *Chlamydia* sp. and/or
(ii) two MOMP VD2 sequences of different serovars of the *Chlamydia* sp.; and/or
(iii) one MOMP VD3 sequence; and/or
(iv) two MOMP VD4 sequences of different serovars of the *Chlamydia* sp., optionally wherein the different serovars are selected from serovars D, E, F or G of *C. trachomatis*.

110. The chimeric MOMP VD polypeptide of any one of embodiments 105-109, wherein the chimeric MOMP VD polypeptide comprises one MOMP VD sequence of serovar D or E of *C. trachomatis* and one MOMP VD sequence of serovar F or G of *C. trachomatis*.

111. The chimeric MOMP VD polypeptide of embodiment 109 or 110, wherein the chimeric MOMP VD polypeptide comprises at least one (e.g., four) of (i)-(iv):
(i) a MOMP VD1 sequence from serovar D and a MOMP VD1 sequence from serovar F, or a MOMP VD1 sequence from serovar E and a MOMP VD1 sequence from serovar F or G (e.g., a MOMP VD1 sequence of serovar E and a MOMP VD1 sequence of serovar G); and/or
(ii) a MOMP VD2 sequence from serovar E and a MOMP VD2 sequence from serovar F, or a MOMP VD2 sequence from serovar D and a MOMP VD2 sequence from serovar G (e.g., a MOMP VD2 sequence of serovar D and a MOMP VD2 sequence of serovar G); and/or
(iii) a MOMP VD3 sequence from serovar G or a VD3 sequence from serovar F (e.g., serovar F); and/or
(iv) a MOMP VD4 sequence from serovar E and a MOMP VD4 sequence from serovar G, or a MOMP VD4 sequence from serovar D and a MOMP VD4 sequence from serovar F (e.g., a MOMP VD4 sequence of serovar D and a MOMP VD4 sequence of serovar F), wherein the serovars D, E, F or G are of *C. trachomatis*.

112. The chimeric MOMP VD polypeptide of embodiment 111, wherein the chimeric MOMP VD polypeptide comprises:
(i) a MOMP VD1 sequence from serovar D and a MOMP VD1 sequence from serovar F, a MOMP VD2 sequence from serovar E and a MOMP VD2 sequence from serovar F, a MOMP VD3 sequence from serovar G, a MOMP VD4 sequence from serovar E and a MOMP VD4 sequence from serovar G; or
(ii) a MOMP VD1 sequence from serovar E and a MOMP VD1 sequence from serovar F, a MOMP VD2 sequence from serovar D and a MOMP VD2 sequence from serovar G, a MOMP VD3 sequence from serovar F, a MOMP VD4 sequence from serovar D and a MOMP VD4 sequence from serovar F, wherein the serovars D, E, F or G are of *C. trachomatis*.

113. The chimeric MOMP VD polypeptide of embodiment 112, wherein the chimeric MOMP VD polypeptide comprises MOMP VD sequences according to (ii).

114. The chimeric MOMP VD polypeptide of any one of embodiments 107-113, wherein the conserved domain sequence portions are portions of conserved domain sequences of a native *Chlamydia* sp. MOMP polypeptide flanking the VD in its native *Chlamydia* sp. MOMP polypeptide.

115. The chimeric MOMP VD polypeptide of any one of embodiments 107-114, wherein each conserved domain sequence portion comprises between 3 and 30 amino acid residues of a conserved domain sequence of a native *Chlamydia* sp. MOMP polypeptide, wherein the between 3 and 30 amino acid residues are immediately adjacent to the VD sequence in its native *Chlamydia* sp. MOMP polypeptide.

116. The chimeric MOMP VD polypeptide of any one of embodiments 105-115, wherein the chimeric MOMP VD polypeptide comprises a single amino acid substitution at one or more (e.g., all) positions corresponding to a cysteine residue in a conserved domain sequence of a native *Chlamydia* sp. MOMP polypeptide, optionally wherein the single amino acid substitution is a substitution of cysteine with serine.

117. The chimeric MOMP VD polypeptide of any one of embodiments 105-116, wherein the chimeric MOMP VD polypeptide comprises a mutation at one or more (e.g., all) positions corresponding to a glycosylation site, optionally an N-glycosylation site, in a native *Chlamydia* sp. MOMP polypeptide, optionally wherein the mutation is a single amino acid substitution.

118. The chimeric MOMP VD polypeptide of embodiment 117, wherein chimeric MOMP VD polypeptide comprises a single amino acid substitution at each of the amino acid residues corresponding to position 9 of SEQ ID NO: 9 (e.g., N to A substitution), position 11 of SEQ ID NO: 17 (e.g., T to A substitution), position 17 of SEQ ID NO: 6 (e.g., S to A substitution), positions 4 and 21 of SEQ ID NO: 18 (e.g., N to A and S to A substitutions, respectively), position 14 of SEQ ID NO: 8 (e.g., a T to A substitution) and position 14 in SEQ ID NO: 16 (e.g., T to A substitution)

119. The chimeric MOMP VD polypeptide of any one of embodiments 105-118, wherein the chimeric MOMP VD polypeptide comprises a sequence according to any one of SEQ ID NO: 490-505 or a sequence that has at least 70% (e.g., at least 90 or 95%) identity thereto, e.g., wherein the chimeric MOMP VD polypeptide comprises a sequence according to SEQ ID NO: 503 or a sequence that has at least 70% (e.g., at least 90 or 95%) identity thereto.

120. A composition comprising the nucleic acid of any one of embodiments 83-104, e.g., wherein the composition is an immunogenic composition.

121. A composition comprising the polypeptide of any one of embodiments 105-119, e.g., wherein the composition is an immunogenic composition.

122. The composition of embodiment 120, wherein the composition further comprises:
(i) a nucleic acid that comprises a nucleotide sequence encoding a modified MOMP polypeptide, wherein the modified MOMP polypeptide has an amino acid sequence comprising two or more conserved domain sequences of a native *Chlamydia* sp. MOMP polypeptide and a non-native loop sequence between the conserved domain sequences; and/or
(ii) one or more (e.g., one, two, three or four) of:
(a) a nucleic acid that comprises a nucleotide sequence encoding a *Chlamydia* sp. CT443 polypeptide;
(b) a nucleic acid that comprises a nucleotide sequence encoding a *Chlamydia* sp. CT584 polypeptide;
(c) a nucleic acid that comprises a nucleotide sequence encoding a *Chlamydia* sp. CT600 polypeptide; or
(d) a nucleic acid that comprises a nucleotide sequence encoding a *Chlamydia* sp. CT812 polypeptide.

123. The composition of embodiment 122, wherein the composition comprises the nucleic acid of (i), the nucleic acid of (ii)(a) and the nucleic acid of (ii)(b).

124. The composition of embodiment 122 or 123, wherein one or more nucleic acids is a mRNA, optionally wherein
(i) the mRNA comprises at least one 5' untranslated region (5' UTR), at least one 3' untranslated region (3' UTR), and/or at least one polyadenylation (poly (A)) sequence;
(ii) the mRNA is unmodified or comprises at least one chemical modification, optionally wherein the mRNA comprises at least one chemical modification e.g., wherein the chemical modification comprises N1-methylpseudouridine; and/or
(iii) the mRNA is a self-replicating mRNA or a non-replicating mRNA, e.g., a non-replicating mRNA.

125. The composition of any one of embodiments 120 or 122-124, wherein the composition further comprises a lipid nanoparticle (LNP), optionally wherein the nucleic acid is encapsulated in the LNP.

126. The composition of any one of embodiments 122-125, wherein the nucleic acid encoding the modified MOMP polypeptide is as defined in any one of embodiments 1-19.

127. The composition of any one of embodiments 122-126, wherein any one of the nucleic acid that comprises a nucleotide sequence encoding the *Chlamydia* sp. CT443 polypeptide, the nucleic acid that comprises a nucleotide sequence encoding the *Chlamydia* sp. CT584 polypeptide, the nucleic acid that comprises a nucleotide sequence encoding the *Chlamydia* sp. CT600 polypeptide or the nucleic acid that comprises a nucleotide sequence encoding the *Chlamydia* sp. CT812 polypeptide is as defined in any one of embodiments 55-68.

128. The composition of any one of embodiments 122-127, wherein the composition comprises:
(1) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);
the nucleic acid (e.g., mRNA) of embodiment 101, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68); and
the nucleic acid (e.g., mRNA) comprising a nucleotide sequence encoding the *Chlamydia* sp. CT443 polypeptide, wherein the nucleic acid comprises a nucleotide sequence according to SEQ ID NO: 707 or a sequence that has at least 50% (e.g., at least 75%) identity thereto (e.g., wherein the nucleic acid is the mRNA of embodiment 67); or (2) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);

the nucleic acid (e.g., mRNA) of embodiment 101, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68); and the nucleic acid (e.g., mRNA) comprising a nucleotide sequence encoding the *Chlamydia* sp. CT584 polypeptide, wherein the nucleic acid comprises a nucleotide sequence according to SEQ ID NO: 715 or a sequence that has at least 50% (e.g., at least 75%) identity thereto (e.g., wherein the nucleic acid is the mRNA of embodiment 67); or (3) the nucleic acid (e.g., mRNA) of embodiment 16, wherein the nucleic acid comprises a nucleotide sequence according to SEQ ID NO: 551 or a sequence that has at least 50% (e.g., at least 75%) identity thereto (e.g., wherein the nucleic acid is a mRNA of embodiment 18 or 19);

the nucleic acid (e.g., mRNA) of embodiment 101, wherein the nucleic acid comprises a nucleotide sequence according to SEQ ID NO: 617 or a sequence that has at least 50% (e.g., at least 75%) identity thereto (e.g., wherein the nucleic acid is the mRNA of embodiment 68);

the nucleic acid (e.g., mRNA) comprising a nucleotide sequence encoding the *Chlamydia* sp. CT443 polypeptide, wherein the nucleic acid comprises a nucleotide sequence according to SEQ ID NO: 707 or a sequence that has at least 50% (e.g., at least 75%) identity thereto (e.g., wherein the nucleic acid is the mRNA of embodiment 67); and the nucleic acid (e.g., mRNA) comprising a nucleotide sequence encoding the *Chlamydia* sp. CT584 polypeptide, wherein the nucleic acid comprises a nucleotide sequence according to SEQ ID NO: 715 or a sequence that has at least 50% (e.g., at least 75%) identity thereto (e.g., wherein the nucleic acid is the mRNA of embodiment 67); or (4) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;

the nucleic acid (e.g., mRNA) of embodiment 101, wherein the chimeric MOMP VD polypeptide comprises a sequence according to SEQ ID NO: 503 or a sequence that has at least 75% (e.g., at least 90 or 95%) identity thereto; and the nucleic acid (e.g., mRNA) comprising a nucleotide sequence encoding the *Chlamydia* sp. CT443 polypeptide, wherein the encoding the *Chlamydia* sp. CT443 polypeptide comprises a sequence according to SEQ ID NO: 507 or a sequence that has at least 75% (e.g., at least 90 or 95%) identity thereto; or (5) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;

the nucleic acid (e.g., mRNA) of embodiment 101, wherein the chimeric MOMP VD polypeptide comprises a sequence according to SEQ ID NO: 503 or a sequence that has at least 75% (e.g., at least 90 or 95%) identity thereto; and the nucleic acid comprising a nucleotide sequence encoding the *Chlamydia* sp. CT584 polypeptide, wherein the *Chlamydia* sp. CT584 polypeptide comprises a sequence according to SEQ ID NO: 510 or a sequence that has at least 75% (e.g., at least 90 or 95%) identity thereto; or (6) the nucleic acid (e.g., mRNA) of embodiment 15, wherein the modified MOMP polypeptide comprises a sequence according to SEQ ID NO: 486 or a sequence that has at least 70% (e.g., at least 90 or 95%) identity thereto;

the nucleic acid (e.g., mRNA) of embodiment 101, wherein the chimeric MOMP VD polypeptide comprises a sequence according to SEQ ID NO: 503 or a sequence that has at least 75% (e.g., at least 90 or 95%) identity thereto;

the nucleic acid (e.g., mRNA) comprising a nucleotide sequence encoding the *Chlamydia* sp. CT443 polypeptide, wherein the encoding the *Chlamydia* sp. CT443 polypeptide comprises a sequence according to SEQ ID NO: 507 or a sequence that has at least 75% (e.g., at least 90 or 95%) identity thereto; and the nucleic acid comprising a nucleotide sequence encoding the *Chlamydia* sp. CT584 polypeptide, wherein the *Chlamydia* sp. CT584 polypeptide comprises a sequence according to SEQ ID NO: 510 or a sequence that has at least 75% (e.g., at least 90 or 95%) identity thereto, e.g., wherein the composition comprises the nucleic acids as defined in (3) or the nucleic acids as defined in (6).

129. The composition of embodiment 121, wherein the composition further comprises:
(i) a modified MOMP polypeptide, wherein the modified MOMP polypeptide has an amino acid sequence comprising two or more conserved domain sequences of a native *Chlamydia* sp. MOMP polypeptide and a non-native loop sequence between the conserved domain sequences; and/or
(ii) one or more (e.g., one, two, three, or four) of:
(a) a polypeptide comprising an amino acid sequence of a *Chlamydia* sp. CT443 polypeptide;
(b) a polypeptide comprising an amino acid sequence of a *Chlamydia* sp. CT584 polypeptide;
(c) a polypeptide comprising an amino acid sequence of a *Chlamydia* sp. CT600 polypeptide; or
(d) a polypeptide comprising an amino acid sequence of a *Chlamydia* sp. CT812 polypeptide.

130. The composition of embodiment 129, wherein the composition comprises
the polypeptide of (i) and the polypeptide of (ii)(a); or
the polypeptide of (i) and the polypeptide of (ii)(b); or
the polypeptide of (1), the polypeptide of (ii)(a) and the polypeptide of (ii)(b),
e.g., wherein the composition comprises the polypeptide of (i), the polypeptide of (ii)(a) and the polypeptide of (ii)(b).

131. The composition of any one of embodiments 129 or 130, wherein the modified MOMP polypeptide is as defined in any one of embodiments 20-30.

132. The composition of any one of embodiments 129-131, wherein any one of the *Chlamydia* sp. CT443 polypeptide, the *Chlamydia* sp. CT584 polypeptide, the *Chlamydia* sp. CT600 polypeptide or the *Chlamydia* sp. CT812 polypeptide is as defined in any one of embodiments 55-68.

133. The composition of any one of embodiments 129-132, wherein the composition comprises:
(1) the modified MOMP polypeptide that comprises a sequence according to SEQ ID NO: 486 or a sequence that has at least 70% (e.g., at least 90 or 95%) identity thereto;
the chimeric *Chlamydia* sp. MOMP VD polypeptide that comprises a sequence according to SEQ ID NO: 503 or a sequence that has at least 75% (e.g., at least 90 or 95%) identity thereto; and
the *Chlamydia* sp. CT443 polypeptide that comprises a sequence according to SEQ ID NO: 507 or a sequence that has at least 75% (e.g., at least 90 or 95%) identity thereto; or
(2) the modified MOMP polypeptide that comprises a sequence according to SEQ ID NO: 486 or a sequence that has at least 70% (e.g., at least 90 or 95%) identity thereto;
the chimeric *Chlamydia* sp. MOMP VD polypeptide that comprises a sequence according to SEQ ID NO: 503 or a sequence that has at least 75% (e.g., at least 90 or 95%) identity thereto; and
the *Chlamydia* sp. CT584 polypeptide that comprises a sequence according to SEQ ID NO: 510 or a sequence that has at least 75% (e.g., at least 90 or 95%) identity thereto; or
(3) the modified MOMP polypeptide that comprises a sequence according to SEQ ID NO: 486 or a sequence that has at least 70% (e.g., at least 90 or 95%) identity thereto;
the chimeric *Chlamydia* sp. MOMP VD polypeptide that comprises a sequence according to SEQ ID NO: 503 or a sequence that has at least 75% (e.g., at least 90 or 95%) identity thereto;
the *Chlamydia* sp. CT443 polypeptide that comprises a sequence according to SEQ ID NO: 507 or a sequence that has at least 75% (e.g., at least 90 or 95%) identity thereto; and
the *Chlamydia* sp. CT584 polypeptide that comprises a sequence according to SEQ ID NO: 510 or a sequence that has at least 75% (e.g., at least 90 or 95%) identity thereto,
e.g., wherein the composition comprises the polypeptides as defined in (3).

134. The composition of any one of embodiments 121 or 129-133, wherein the composition further comprises an adjuvant.

135. The composition of embodiment 125, wherein the LNP comprises at least one cationic lipid, optionally wherein:
(i) the cationic lipid is selected from the group consisting of OF-02, cKK-E10, OF-Deg-Lin, GL-HEPES-E3-E10-DS-3-E18-1, GL-HEPES-E3-E12-DS-4-E10, GL-HEPES-E3-E12-DS-3-E14, SM-102, ALC-0315, ATX-126, and IM-001 (e.g., GL-HEPES-E3-E12-DS-4-E10 or IM-001); and/or
(ii) the LNP further comprises a polyethylene glycol (PEG) conjugated (PEGylated) lipid, a cholesterol-based lipid, and a helper lipid, optionally wherein the (PEGylated) lipid is DMG-PEG2000 or ALC-0159 (e.g., DMG-PEG2000);
the cholesterol-based lipid is cholesterol; and/or
the helper lipid is DOPE or DSPC; and/or (iii) the LNP comprises:
(1) OF-02 at a molar ratio of 40%, DMG-PEG2000 at a molar ratio of 1.5%, cholesterol at a molar ratio of 28.5%, and DOPE at a molar ratio of 30%;
(2) cKK-E10 at a molar ratio of 40%, DMG-PEG2000 at a molar ratio of 1.5%, cholesterol at a molar ratio of 28.5%, and DOPE at a molar ratio of 30%;
(3) GL-HEPES-E3-E10-DS-3-E18-1 at a molar ratio of 40%, DMG-PEG2000 at a molar ratio of 1.5%, cholesterol at a molar ratio of 28.5%, and DOPE at a molar ratio of 30%;
(4) GL-HEPES-E3-E12-DS-4-E10 at a molar ratio of 40%, DMG-PEG2000 at a molar ratio of 1.5%, cholesterol at a molar ratio of 28.5%, and DOPE at a molar ratio of 30%;
(5) GL--EPES-E3-E12-DS-3-E14 at a molar ratio of 40%, DMG-PEG2000 at a molar ratio of 1.5%, cholesterol at a molar ratio of 28.5%, and DOPE at a molar ratio of 30%;
(6) DLin-MC3-DMA (MC3) at a molar ratio of 50%, DMG-PEG2000 at a molar ratio of 1.5%, cholesterol at a molar ratio of 38.5%, and DSPC at a molar ratio of 10%; or
(7) IM-001 at a molar ratio of 40%, DMG-PEG2000 at a molar ratio of 1.5%, cholesterol at a molar ratio of 28.5%, and DOPE at a molar ratio of 30%,
(8) SM-102 at a molar ratio of 50%, DMG-PEG2000 at a molar ratio of 1.5%, cholesterol at a molar ratio of 38.5%, and DSPC at a molar ratio of 10%;
(9) ALC-0315 at a molar ratio of 46.3%, ALC-0159 at a molar ratio of 1.6%, cholesterol at a molar ratio of 42.7%, and DSPC at a molar ratio of 9.4%;
(10) ALC-0315 at a molar ratio of 47.4%, ALC-0159 at a molar ratio of 1.7%, cholesterol at a molar ratio of 40.9%, and DSPC at a molar ratio of 10%; or
(11) ATX-126 a molar ratio of 50%; DMG-PEG2000 at a molar ratio of 1.5%, cholesterol at a molar ratio of 38.5%, and DSPC at a molar ratio of 10%,
e.g., wherein the LNP is as defined in (1), (2), (4) or (7), e.g., wherein the LNP is as defined in (4) or (7).

136. The composition of any one of embodiments 120-135, wherein the *Chlamydia* sp. is *Chlamydia* trachomatis.

137. A combination comprising a nucleic acid of any one of embodiments 83-104 and:
(i) a nucleic acid that comprises a nucleotide sequence encoding a modified MOMP polypeptide, wherein the modified MOMP polypeptide has an amino acid sequence comprising two or more conserved domain sequences of a native *Chlamydia* sp. MOMP polypeptide and a non-native loop sequence between the conserved domain sequences; and/or
(ii) one or more (e.g., one, two, three, or four) of:
(a) a nucleic acid that comprises a nucleotide sequence encoding a *Chlamydia* sp. CT443 polypeptide;
(b) a nucleic acid that comprises a nucleotide sequence encoding a *Chlamydia* sp. CT584 polypeptide;
(c) a nucleic acid that comprises a nucleotide sequence encoding a *Chlamydia* sp. CT600 polypeptide; or
(d) a nucleic acid that comprises a nucleotide sequence encoding a *Chlamydia* sp. CT812 polypeptide.

138. The combination of embodiment 137, wherein the composition comprises the nucleic acid of (i) and the nucleic acid of (ii)(a);
the nucleic acid of (i) and the nucleic acid of (ii)(b); or
the nucleic acid of (i), the nucleic acid of (ii)(a) and the nucleic acid of (ii)(b),
e.g., wherein the composition comprises the nucleic acid of (i), the nucleic acid of (ii)(a) and the nucleic acid of (ii)(b),
optionally wherein the nucleic acids are as defined in embodiment 128.

139. A combination comprising a polypeptide of any one of embodiments 105-119 and:
(i) a modified MOMP polypeptide, wherein the modified MOMP polypeptide has an amino acid sequence comprising two or more conserved domain sequences of a native *Chlamydia* sp. MOMP polypeptide and a non-native loop sequence between the conserved domain sequences; and/or
(ii) one or more (e.g., one, two, three, or four) of:
(a) a polypeptide comprising amino acid sequence of a *Chlamydia* sp. CT443 polypeptide;
(b) a polypeptide comprising amino acid sequence of a *Chlamydia* sp. CT584 polypeptide;
(c) a polypeptide comprising amino acid sequence of a *Chlamydia* sp. CT600 polypeptide; or
(d) a polypeptide comprising amino acid sequence of a *Chlamydia* sp. CT812 polypeptide.

140. The combination of embodiment 139, wherein the composition comprises the polypeptide of (i) and the polypeptide of (ii)(a);
the polypeptide of (i) and the polypeptide of (ii)(b); or
the polypeptide of (i), the polypeptide of (ii)(a) and the polypeptide of (ii)(b),
e.g., wherein the composition comprises the polypeptide of (i), the polypeptide of (ii)(a) and the polypeptide of (ii)(b),
optionally wherein the polypeptides are as defined in embodiment 133.

141. The combination of embodiment 137 or 138, wherein the nucleic acids are present in the same composition or in two or more separate compositions.

142. The combination of embodiment 139 or 140, wherein the polypeptides are present in the same composition or in two or more separate compositions.

143. The nucleic acid of any one of embodiments 83-104, the chimeric MOMP VD polypeptide of any one of embodiments 105-119, the composition of any one of embodiments 120-136, or the combination of any one of embodiments 136-142, for use as a medicament.

144. The nucleic acid of any one of embodiments 83-104, the chimeric MOMP VD polypeptide of any one of embodiments 105-119, the composition of any one of embodiments 120-136, or the combination of any one of embodiments 136-142, for use in treating or preventing a *Chlamydia* sp. infection, e.g., wherein the infection is a *C. trachomatis* infection.

145. The nucleic acid, the chimeric MOMP VD polypeptide, the composition, or the combination, for use according to embodiment 144, wherein the infection is a genital infection.

146. A vaccine comprising the nucleic acid of any one of embodiments 83-104, the chimeric MOMP VD polypeptide of any one of embodiments 105-119, the composition of any one of embodiments 120-136, or the combination of any one of embodiments 136-142.

BRIEF DESCRIPTION OF THE DRAWINGS

FIGS. 2A-2B show induction of cross-serovar-responsive (FIG. 2A) CD4+ IFNγ+ T cells and (FIG. 2B) CD8+ IFNγ+ T cells in mice immunised with "mRNA MNR MOMP E FL" or "mRNA UNR MOMP E DII:IV", in response to stimulation with pools of overlapping peptides of MOMP serovar E or F.

FIGS. 4A-4C shows T cell responses in mice immunised with LNP-formulated mRNAs encoding recombinant serovar E MOMP in response to stimulation with (FIG. 4A) UV inactivated EBs, (FIG. 4B) "rMOMP" (recombinant serovar E MOMP protein), and (FIG. 4C) a pool of overlapping serovar E MOMP peptides, assessed in splenic IFNγ ELISPOT.

FIGS. 6A-6C show the induction in mice of (FIG. 6A) IFNγ-producing T cells (in response to MOMP serovar E peptide pools), (FIG. 6B) CD4+ IFNγ T cells, and (FIG. 6C) CD8+ IFNγ T cells following immunisation with "mRNA UNR MOMP E DII:IV" or recombinant serovar E MOMP protein.

FIGS. 10A-10B show induction in mice of (FIG. 10A) CD4+ IFNγ T cell responses and (FIG. 10B) CD8+ IFNγ T cell responses following immunisation with MOMP_P3_ssHA1 ("P3"), MOMP_P5_ssHA1_C2S ("P5 C2S"), MOMP_serE_FL_ssHA1 ("FL"), or MOMP_serE_FL_ssHA1_C2S_Glycneg ("FL C2S Glycneg").

FIGS. 18A-18B show induction in mice of (FIG. 18A) CD4+ IFNγ T cell responses and (FIG. 18B) CD8+ IFNγ T cell responses following immunisation with mRNA encoding non-MOMP Ct antigens "CT443" (Nan96-SS:CT443: 32-576), "CT584" (Nan96HA-SS:CT584:2-183), "CT600" (Nan96HA-SS:CT600:2-188) or "CT812" (Nan96-SS:CT812:32-761), or with recombinant MOMP serovar E protein.

FIGS. 21A-21B show induction in mice of (FIG. 21A) CD4+ IFNγ T cell responses and (FIG. 21B) CD8+ IFNγ T cell responses, following immunisation with mRNA encoding non-MOMP Ct antigens CT443_ssHA1 ("CT443"), CT584_ssHA1_GlycNeg ("CT584_GlycNeg"), or CT600_trunc_ssHA1_Glycneg ("CT600_GlycNeg"), or with mRNA encoding recombinant MOMP serovar E protein as a control.

Figure 1:
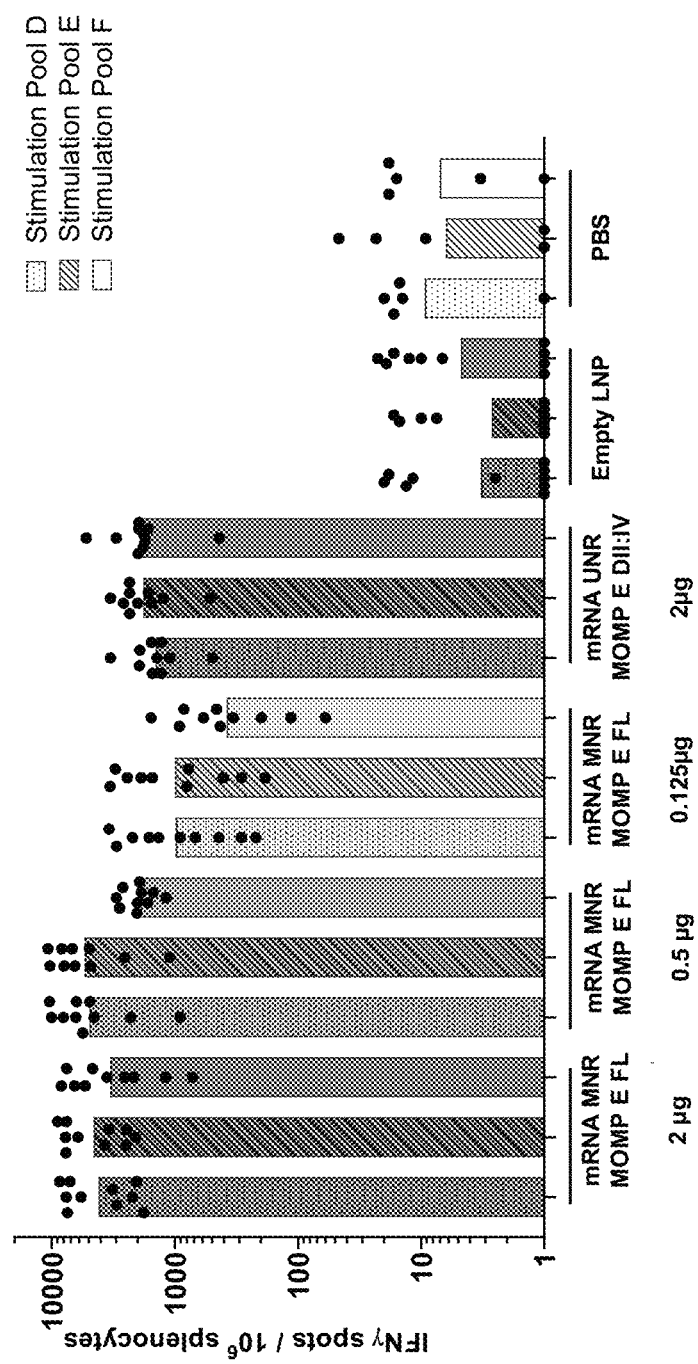
FIG. 1 shows induction of cross-serovar-responsive IFNγ-producing T cells in mice immunised with native SS-MOMP mRNA delivering wild type (WT) full-length MOMP ("mRNA MNR MOMP E FL") or MOMP without variable domains VD2 and VD4 ("mRNA UNR MOMP E DII:IV"), in response to stimulation with pools of overlapping peptides of MOMP serovar D, E or F. MNR=modified mRNA (in which all uridine nucleosides were replaced with 1-methyl pseudo uridine). UNR=unmodified mRNA (containing unmodified uridine nucleosides).

("CT812_ext-pass-dom"), or CT812_ext-pass-domain_ssHA1_C2S ("CT812_ext-pass-dom_C2S").

FIG. 25 shows the level of IgG binding to EBs of serovar D, as measured using ELISA, following immunisation of mice with mRNA encoding non-MOMP Ct antigens as described above in the legend of FIG. 24.

FIG. 26 shows the level of IgG binding to EBs of serovar G, as measured using ELISA, following immunisation of mice with mRNA encoding non-MOMP Ct antigens as described above in the legend of FIG. 24.

FIG. 27 shows antigen-specific IgG levels, as measured using ELISA, following immunisation of mice with mRNA encoding various chimeric MOMP VD polypeptides, with mRNA encoding full-length MOMP polypeptides, or with rMOMP protein.

FIG. 28 shows the level of IgG binding to EBs of serovar E, as measured using ELISA, following immunisation of mice with mRNA encoding various chimeric MOMP VD polypeptides, with mRNA encoding full-length MOMP polypeptides, or with rMOMP protein.

FIG. 29 shows the level of IgG binding to EBs of serovar D, as measured using ELISA, following immunisation of mice with mRNA encoding various chimeric MOMP VD polypeptides, with mRNA encoding full-length MOMP polypeptides, or with rMOMP protein.

FIG. 30 shows the level of IgG binding to EBs of serovar G, as measured using ELISA, following immunisation of mice with mRNA encoding various chimeric MOMP VD polypeptides, with mRNA encoding full-length MOMP polypeptides, or with rMOMP protein.

FIGS. 31A-31C show induction in mice of the (FIG. 31A) CD4+ IFNγ T cell response, (FIG. 31B) CD8+ IFNγ T cell response, and (FIG. 31C) CD4+ IFNγ+IL2+ TNFα+ cell population, following immunisation with mRNA encoding MOMP_P3_ssHA1 ("P3") in two different LNP formulations or MOMP_VDcomb2-extS_ssHA1_Glycneg ("C2-S-GN"). Empty LNPs served as controls.

FIGS. 32A-32B show (FIG. 32A) the level of antigen-specific IgG against recombinant MOMP (rMOMP) of serovar E and (FIG. 32B) the level of IgG binding to EBs of serovar E, as measured using ELISA, following immunisation of mice with mRNA encoding MOMP_VDcomb2-extS_ssHA1_Glycneg ("C2-S-GN") in two different LNP formulations. Empty LNPs and pre-immune sera ("pre-immun") served as controls.

FIGS. 33A-33B show induction in mice of (FIG. 33A) the CD4+ IFNγ T cell response and (FIG. 33B) the percentage of CD4+ T cells in mice that produce IFNγ ("IFNγ"), IL2 and/or TNFα (singularly and in the various combinations thereof), following immunisation with the multivalent composition as described in Example 12, formulated in two different LNP formulations and at three different doses. Empty LNPs corresponding to the amount of LNP used for the doses of 14.4 μg and 4.8 μg mRNA ("equiv. LNP") served as controls.

FIGS. 34A-34B show induction in mice of (FIG. 34A) the CD8+ IFNγ T cell response and (FIG. 34B) the percentage of CD8+ T cells in mice that produce IFNγ ("IFNγ"), IL2 and/or TNFα (singularly and in the various combinations thereof), following immunisation with a multivalent composition as described in Example 12, formulated in two different LNP formulations and at three different doses. Empty LNPs corresponding to the amount of LNP used for the doses of 14.4 μg and 4.8 μg mRNA ("equiv. LNP") served as controls.

FIGS. 35A-35B show (FIG. 35A) the level of antigen-specific IgG against recombinant MOMP (rMOMP) of serovar E and (FIG. 35B) the level of IgG binding to EBs of serovar E, as measured using ELISA, following immunisation of mice with a multivalent composition as described in Example 12, in two different LNP formulations and at three different doses. IgG induced by empty LNPs corresponding to the amount of LNP used for the doses of 14.4 μg and 4.8 μg mRNA ("equiv. LNP") and in pre-immune sera ("pre-immun") are shown as controls.

FIGS. 36A-36B show the level of antigen-specific IgG against the (FIG. 36A) CT443 protein and (FIG. 36B) CT584 protein, as measured using ELISA, following immunisation of mice with a multivalent composition as described in Example 12, in two different LNP formulations and at three different doses. IgG induced by empty LNPs corresponding to the amount of LNP used for the doses of 14.4 μg and 4.8 μg mRNA ("equiv. LNP") and in pre-immune sera ("pre-immun") are shown as controls.

FIGS. 37A-37B show levels of IgG binding to EBs of serovar E, as measured using ELISA, following immunisation of mice with mRNA encoding monovalent polypeptides or a multivalent composition as described in Example 13, formulated in either (FIG. 37A) "Lipid D" or (FIG. 37B) "Lipid G". *** corresponds to a p-value of $p<0.001$.

FIGS. 38A-38B show levels of IgG binding to EBs of serovar G, as measured using ELISA, following immunisation of mice with mRNA encoding monovalent polypeptides or a multivalent composition as described in Example 13, formulated in either (FIG. 38A) "Lipid D" or (FIG. 38B) "Lipid G". *** corresponds to a p-value of $p<0.001$.

FIGS. 39A-39F show levels of IgG binding to recombinant proteins (FIG. 39A and FIG. 39B: MOMP; FIG. 39C and FIG. 39D: CT443; FIG. 39E and FIG. 39F: CT584), as measured using ELISA, following immunisation of mice with mRNA encoding monovalent polypeptides or a multivalent composition as described in Example 13, formulated in either (FIG. 39A, FIG. 39C, FIG. 39E) "Lipid D" or (FIG. 39B, FIG. 39D, FIG. 39F) "Lipid G".

MODES FOR CARRYING OUT THE INVENTION

Example 1—Design of *C. trachomatis* (Ct) Antigen Constructs

Design of T Cell Constructs (Modified MOMP Polypeptide Constructs)

mRNA constructs encoding modified MOMP polypeptide antigens were prepared with the aim of eliciting MOMP-specific T cell responses, particularly MOMP specific IFNγ+ CD4+ T cells—i.e. MOMP T cell constructs.

MOMP T-cell constructs MOMP_P3_ssHA1 ("P3") and MOMP_P5_ssHA1 ("P5") were designed using a structure-based strategy in order to replace VD1-4 regions (which contain B-cell epitopes).

As a basis for the structure guided design, Alphafold2 (Deepmind) was used to create a 3D model of the MOMP protein. The resulting MOMP model structure can be described as a beta-barrel made up of 10 antiparallel beta strands. The VD1-4 regions are situated in loops linking individual beta-strands, all located on the same side of the barrel structure.

In order to design replacement sequences for the VD1-4 loops, each VD sequence was mapped onto the MOMP model structure. The distance between the start and end of each VD region was measured, and the approximate peptide sequence length needed to cover this distance between the start and end points of each VD was estimated.

The "Crosslink Proteins" (CS) protocol available through Maestro (v12.8, Schrodinger) was used to build peptide sequences of diverse lengths and amino-acid composition on the MOMP model structure, in order to replace the VD regions. After energy minimization and visual inspection of resulting MOMP structures, a shortlist of 6 MOMP VD-replaced sequences were selected for further analysis.

In order to avoid issues related to human cross reactivity for the newly designed VD-replaced MOMP sequences, sequence motifs of 8 or more amino acids in the VD-replaced MOMP sequences, which are also present in the human proteome, were excluded from potential designs.

Finally, a VD1-4-replaced MOMP sequence was selected in which the VD replacement peptides/loops are predicted to have minimal impact on the overall MOMP beta-barrel structure, and which has no sequence motif (8 or more amino acids) in common with sequences present in the human proteome.

The resulting T-cell constructs MOMP_P3_ssHA1 ("P3") and MOMP_P5_ssHA1 ("P5") are given by SEQ ID NOs: 53 and 57, respectively.

Design of B Cell Constructs (Chimeric MOMP VD Polypeptide Constructs)

Further mRNA constructs encoding chimeric MOMP VD polypeptide antigens were prepared with the aim of eliciting MOMP-specific antibody (B cell) responses—i.e. MOMP B cell constructs.

The exemplary B cell constructs are chimeras which were designed by combining variable domains (VD) from 4 serovars of *C. trachomatis* (SerD, SerE, SerF & SerG). A chimeric antigen was obtained which combines copies of each of the 4 variable domains (VD1 to VD4) from different serovars, designed in this way in order to be able to induce a cross-serovar immune (antibody) response. A protein sequence comparison of the VD loops across serovars (SEQ ID NOs: 5 to 20) indicated that:

VD1 loops of SerD and SerE are highly similar, and VD1 loops of SerF and SerG are identical
VD2 loops of SerD and SerE are highly similar, and VD2 loops of SerF and SerG are highly similar
VD3 loops of SerD and SerF are identical, and VD3 loops of SerF and SerG are highly similar
VD4 loops of SerD and SerE are highly similar, and VD4 loops of SerF and SerG are highly similar It was hypothesized that highly similar or identical sequences of VD loops between two serovars might be able to contribute to a cross-serovar response at least between those two serovars. Therefore, the designed chimeras contained two of each of VD1, VD2 and VD4 (i.e., 1 VD from D or E+1 VD for F or G, for each of the VD loops). Due to a putative homology with a human protein the VD3 from SerE was excluded from the designs and only one VD3 (from SerG or SerD/F*) was included.

To maintain the VD loops in a conformation which is structurally similar to that of the VD loops within native MOMP, some of the flanking residues either side of the VD loops were included in the designed constructs. Two construct groups with different lengths of flanking sequences either side of the VD loops were designed (extP and extS).

Two construct groups with different combinations of VD loops were also designed (VDcomb1 and VDcomb2).

VDcomb1 contains the following VD loops:

VD1(serD)-VD1(serF/G*)-VD2(serE)-VD2(serF)-VD3(serG)-VD4(serE)-VD4(serG)

VDcomb2 contains the following VD loops:

VD1(serE)-VD1(serF/G*)-VD2(serD)-VD2(serG)-VD3(serD/F*)-VD4(serD)-VD4(serF)

* the sequences for this particular VD from these serovars are identical

The resulting B cell constructs are given by protein sequences according to SEQ ID NO: 61-92.

Example 2—Expression of mRNA Constructs mRNA constructs encoding a selection of *C. trachomatis* (Ct) antigens were provided and expressed in HeLa cells as described in the Methods section.

Results

The following constructs were expressed and detected in lysate and/or supernatant, as indicated in Table 4 below. Expression in the supernatant indicated that the protein was secreted.

ssHA1=signal peptide sequence of SEQ ID NO:187; ssHA2 signal peptide sequence of SEQ ID NO:188; TMB1=transmembrane domain sequence of SEQ ID NO: 189; TMB2=transmembrane domain sequence of SEQ ID NO: 190; FL=full-length protein; C2S=variant containing cysteine to serine mutations which are designed to remove any disulphide bridges; GlycNeg=variant containing point mutations designed to prevent glycosylation; P3 and P5=MOMP variants (T cell constructs) in which the variable loops (VDs) have been replaced using a structure-based strategy according to the design strategy described in Example 1; VDcomb=chimeric MOMP variants (B cell constructs) in which variable loops (VDs) from different serovars are combined according to the design strategy described in Example 1; extP and extS=VDcomb construct which have different lengths of flanking sequences either side of the VD included (see Example 1 for design strategy); trunc=a truncated version of the relevant protein; CT812_pass-domain=CT812 fragment corresponding to amino acid residues 52-1003 of CT812 (SEQ ID NO: 515); CT812_ext_pass-domain=CT812 fragment corresponding to amino acid residues 52-1179 of CT812 (SEQ ID NO: 515); HPXn-n_HPXn-n=constructs in which sequence motifs of 8 or more amino-acids, which are also present in the human proteome, were mutated in order to avoid human cross reactivity; N.D.=not determined.

TABLE 4 mRNA constructs expressed in HeLa cells

| SEQ ID NO | Construct Name | Lysate Expression | Supernatant Expression |
|---|---|---|---|
| Full Length MOMP | | | |
| 879 | MOMP_serD_FL_ssHA1 | +++ | + |
| 294 | MOMP_serD_FL_ssHA1 | +++ | + |

TABLE 4-continued mRNA constructs expressed in HeLa cells

| SEQ ID NO | Construct Name | Lysate Expression | Supernatant Expression |
|---|---|---|---|
| 297 | MOMP_serD_FL_ssHA1_Glycneg | +++ | + |
| 298 | MOMP_serD_FL_ssHA1_Glycneg | +++ | + |
| 873 | MOMP_serD_FL_ssHA1_C2S_Glycneg | +++ | +++ |
| 875 | MOMP_serE_FL_ssHA1 | +++ | ++ |
| 876 | MOMP_serE_ssHA1_C2S_Glycneg | +++ | + |
| 880 | MOMP_serF_FL_ssHA1 | +++ | + |
| 326 | MOMP_serF_FL_ssHA1 | +++ (brighter) | + |
| 338 | MOMP_serF_FL_ssHA2_Glycneg | +++ | +++ |
| 881 | MOMP_serG_FL_ssHA1 | +++ | + |
| 342 | MOMP_serG_FL_ssHA1 | +++ (brighter) | + |
| 345 | MOMP_serG_FL_ssHA1_Glycneg | + | +++ |
| T Cell Constructs | | | |
| 213 | MOMP_P3_ssHA1 | + (Brighter) | not detected |
| 218 | MOMP_P3_ssHA1_C2S | + (Brighter) | + |
| 219 | MOMP_P3_ssHA2_C2S | ++ | ++ |
| 222 | MOMP_P5_ssHA1 | +++ | + |
| 225 | MOMP_P5_ssHA1_C2S | + | + |
| B Cell Constructs | | | |
| 229 | MOMP_VDcomb1-extP_ssHA1 | +++ | + |
| 863 | MOMP_VDcomb1-extP_ssHA1 | +++ | + |
| 877 | MOMP_VDcomb1-extP_ssHA1_Glycneg | +++ | ++ |
| 232 | MOMP_VDcomb1-extP_ssHA1_Glycneg | +++ | +++ |
| 233 | MOMP_VDcomb1-extP_ssHA1_TMB1 | + | N.D. |
| 234 | MOMP_VDcomb1-extP_ssHA1_TMB1 | + | N.D. |
| 235 | MOMP_VDcomb1-extP_ssHA1_TMB1_Glycneg | ++ | N.D. |
| 865 | MOMP_VDcomb1-extP_ssHA1_TMB1_Glycneg | ++ | N.D. |
| 237 | MOMP_VDcomb1-extP_ssHA2 | +++ | + |
| 238 | MOMP_VDcomb1-extP_ssHA2 | +++ | + |
| 239 | MOMP_VDcomb1-extP_ssHA2_Glycneg | +++ | ++ |
| 242 | MOMP_VDcomb1-extP_ssHA2_TMB2 | + | N.D. |
| 243 | MOMP_VDcomb1-extP_ssHA2_TMB2_Glycneg | ++ | N.D. |
| 244 | MOMP_VDcomb1-extP_ssHA2_TMB2_Glycneg | ++ | N.D. |
| 245 | MOMP_VD-comb1-extS_ssHA1 | +++ | not detected |
| 864 | MOMP_VD-comb1-extS_ssHA1 | +++ | +++ |
| 878 | MOMP_VD-comb1-extS_ssHA1_Glycneg | +++ | +++ |
| 248 | MOMP_VD-comb1-extS_ssHA1_Glycneg | +++ | +++ |
| 249 | MOMP_VD-comb1-extS_ssHA1_TMB1 | ++ | N.D. |
| 251 | MOMP_VD-comb1-extS_ssHA1_TMB1_Glycneg | ++ | N.D. |
| 866 | MOMP_VD-comb1-extS_ssHA1_TMB1_Glycneg | ++ | N.D. |
| 253 | MOMP_VD-comb1-extS_ssHA2 | +++ | +++ |
| 254 | MOMP_VD-comb1-extS_ssHA2 | +++ | +++ |
| 255 | MOMP_VD-comb1-extS_ssHA2_Glycneg | +++ | +++ |
| 256 | MOMP_VD-comb1-extS_ssHA2_Glycneg | +++ | +++ |
| 257 | MOMP_VD-comb1-extS_ssHA2_TMB2 | ++ | N.D. |
| 258 | MOMP_VD-comb1-extS_ssHA2_TMB2 | ++ | N.D. |
| 259 | MOMP_VD-comb1-extS_ssHA2_TMB2_Glycneg | ++ | N.D. |
| 260 | MOMP_VD-comb1-extS_ssHA2_TMB2_Glycneg | ++ | N.D. |
| 261 | MOMP_VDcomb2-extP_ssHA1 | ++ | + |
| 262 | MOMP_VDcomb2-extP_ssHA1 | ++ | + |
| 868 | MOMP_VDcomb2-extP_ssHA1_Glycneg | +++ | ++ |
| 264 | MOMP_VDcomb2-extP_ssHA1_Glycneg | +++ | + |
| 265 | MOMP_VDcomb2-extP_ssHA1_TMB1 | + | N.D. |
| 266 | MOMP_VDcomb2-extP_ssHA1_TMB1 | + | N.D. |
| 871 | MOMP_VDcomb2-extP_ssHA1_TMB1_Glycneg | ++ | N.D. |
| 268 | MOMP_VDcomb2-extP_ssHA1_TMB1_Glycneg | + | N.D. |
| 269 | MOMP_VDcomb2-extP_ssHA2 | ++ | + |
| 270 | MOMP_VDcomb2-extP_ssHA2 | ++ | + |
| 869 | MOMP_VDcomb2-extP_ssHA2_Glycneg | +++ | ++ |
| 272 | MOMP_VDcomb2-extP_ssHA2_Glycneg | +++ | ++ |
| 273 | MOMP_VDcomb2-extP_ssHA2_TMB2 | + | N.D. |
| 274 | MOMP_VDcomb2-extP_ssHA2_TMB2 | + | N.D. |
| 867 | MOMP_VDcomb2-extP_ssHA2_TMB2_Glycneg | + | N.D. |
| 276 | MOMP_VDcomb2-extP_ssHA2_TMB2_Glycneg | + | N.D. |
| 277 | MOMP_VDcomb2-extS_ssHA1 | +++ | +++ |
| 278 | MOMP_VDcomb2-extS_ssHA1 | +++ | +++ |
| 870 | MOMP_VDcomb2-extS_ssHA1_Glycneg | +++ | +++ |
| 280 | MOMP_VDcomb2-extS_ssHA1_Glycneg | +++ | +++ |
| 872 | MOMP_VDcomb2-extS_ssHA1_TMB1 | + | N.D. |
| 282 | MOMP_VDcomb2-extS_ssHA1_TMB1 | + | N.D. |

TABLE 4-continued mRNA constructs expressed in HeLa cells

| SEQ ID NO | Construct Name | Lysate Expression | Supernatant Expression |
|---|---|---|---|
| 283 | MOMP_VDcomb2-extS_ssHA1_TMB1_Glycneg | ++ | N.D. |
| 285 | MOMP_VDcomb2-extS_ssHA2 | +++ | +++ |
| 287 | MOMP_VDcomb2-extS_ssHA2_Glycneg | +++ | +++ |
| 290 | MOMP_VDcomb2-extS_ssHA2_TMB2 | ++ | N.D. |
| 291 | MOMP_VDcomb2-extS_ssHA2_TMB2_Glycneg | ++ | N.D. |
| 292 | MOMP_VDcomb2-extS_ssHA2_TMB2_Glycneg | ++ | N.D. |
| Non-MOMP Constructs | | | |
| 369 | CT443_ssHA1 PolyA | + | not detected (band size is at albumin band) |
| 370 | CT443_ssHA1 PolyA | + | not detected (band size is at albumin band) |
| 371 | CT443_ssHA1_Glycneg PolyA | + | not detected (band size is at albumin band) |
| 372 | CT443_ssHA1_Glycneg PolyA | + | not detected (band size is at albumin band) |
| 373 | CT584_ssHA1 PolyA | + | + |
| 374 | CT584_ssHA1 PolyA | +++ | +++ |
| 375 | CT584_ssHA1_C2S PolyA | ++ | ++ |
| 376 | CT584_ssHA1_C2S PolyA | ++ | ++ |
| 377 | CT584_ssHA1_Glycneg PolyA | +++ | +++ |
| 378 | CT584_ssHA1_Glycneg PolyA | +++ | +++ |
| 379 | CT584_ssHA1_Glycneg_C2S PolyA | ++ | ++ |
| 380 | CT584_ssHA1_Glycneg_C2S PolyA | ++ | ++ |
| 381 | CT600_trunc_ssHA1 | +++ | +++ |
| 382 | CT600_trunc_ssHA1 | +++ | ++ |
| 383 | CT600_trunc_ssHA1_Glycneg | +++ | +++ |
| 384 | CT600_trunc_ssHA1_Glycneg | +++ | +++ |
| 385 | CT812_pass-domain_ssHA1 | ++ (brighter) | not detected |
| 386 | CT812_pass-domain_ssHA1 | ++ | not detected |
| 387 | CT812_pass-domain_ssHA1_C2S | ++ | not detected |
| 388 | CT812_pass-domain_ssHA1_C2S | ++ | not detected |
| 389 | CT812_ext-pass-domain_ssHA1 | + | not detected |
| 390 | CT812_ext-pass-domain_ssHA1 | + | not detected |
| 391 | CT812_ext-pass-domain_ssHA1_C2S PolyA | + | not detected |
| 392 | CT812_ext-pass-domain_ssHA1_C2S PolyA | + | not detected |
| 393 | CT812_pass-domain_ssHA1_HPX1-2_HPX2-1 CO1 | +++ | + |
| 394 | CT812_pass-domain_ssHA1_HPX1-2_HPX2-1 CO2 | +++ | +/− |
| 395 | CT812_pass-domain_ssHA1_HPX1-2_HPX2-1_C2S CO1 | +++ | +/− |
| 396 | CT812_pass-domain_ssHA1_HPX1-2_HPX2-1_C2S CO2 | +++ | +/− |
| 397 | CT812_ext-pass-domain_ssHA1_HPX1-2_HPX2-3_C2S CO1 | +++ | + |
| 398 | CT812_ext-pass-domain_ssHA1_HPX1-2_HPX2-3_C2S CO2 | +++ | + |
| 399 | CT812_pass-domain_ssHA1_HPX1-1_HPX2-1 CO1 | +++ | + |
| 400 | CT812_pass-domain_ssHA1_HPX1-1_HPX2-1 CO2 | +++ | +/− |
| 401 | CT812_ext-pass-domain_ssHA1_HPX1-1_HPX2-3 CO1 | +++ | + |
| 402 | CT812_ext-pass-domain_ssHA1_HPX1-1_HPX2-3 CO2 | +++ | + |
| 403 | CT812_ext-pass-domain_ssHA1_HPX1-1_HPX2-1 CO1 | +++ | + |
| 404 | CT812_ext-pass-domain_ssHA1_HPX1-1_HPX2-1 CO2 | +++ | + |
| 405 | CT812_pass-domain_ssHA1_HPX1-2_HPX2-3 CO1 | +++ | + |
| 406 | CT812_pass-domain_ssHA1_HPX1-2_HPX2-3 CO2 | +++ | + |
| 407 | CT812_pass-domain_ssHA1_HPX1-2_HPX2-3_C2S CO1 | +++ | +/− |
| 408 | CT812_pass-domain_ssHA1_HPX1-2_HPX2-3_C2S CO2 | +++ | +/− |
| 409 | CT812_ext-pass-domain_ssHA1_HPX1-2_HPX2-1_C2S CO1 | +++ | + |
| 410 | CT812_ext-pass-domain_ssHA1_HPX1-2_HPX2-1_C2S CO2 | +++ | + |
| 411 | CT812_pass-domain_ssHA1_HPX1-1_HPX2-3 CO1 | +++ | + |
| 412 | CT812_pass-domain_ssHA1_HPX1-1_HPX2-3 CO2 | +++ | +/− |
| 413 | CT812_pass-domain_ssHA1_HPX1-1_HPX2-1_C2S CO1 | +++ | +/− |
| 414 | CT812_pass-domain_ssHA1_HPX1-1_HPX2-1_C2S CO2 | +++ | +/− |
| 415 | CT812_ext-pass-domain_ssHA1_HPX1-1_HPX2-3_C2S CO1 | +++ | + |
| 416 | CT812_ext-pass-domain_ssHA1_HPX1-1_HPX2-3_C2S CO2 | +++ | + |
| 417 | CT812_pass-domain_ssHA1_HPX1-1_HPX2-3_C2S CO1 | +++ | + |
| 418 | CT812_pass-domain_ssHA1_HPX1-1_HPX2-3_C2S CO2 | +++ | +/− |
| 419 | CT812_ext-pass-domain_ssHA1_HPX1-2_HPX2-3 CO1 | +++ | + |
| 420 | CT812_ext-pass-domain_ssHA1_HPX1-2_HPX2-3 CO2 | +++ | + |
| 421 | CT812_ext-pass-domain_ssHA1_HPX1-2_HPX2-1 CO1 | +++ | + |
| 422 | CT812_ext-pass-domain_ssHA1_HPX1-2_HPX2-1 CO2 | +++ | + |
| 423 | CT812_ext-pass-domain_ssHA1_HPX1-1_HPX2-1_C2S CO1 | +++ | + |
| 424 | CT812_ext-pass-domain_ssHA1_HPX1-1_HPX2-1_C2S CO2 | +++ | + |

TABLE 4-continued mRNA constructs expressed in HeLa cells

| SEQ ID NO | Construct Name | Lysate Expression | Supernatant Expression |
|---|---|---|---|
| | Control Constructs | | |
| 862 | Hirep2_ssHA1 | +++ | ++ |
| 202 | Hirep2_ssHA1 | +++ | + |
| 365 | CTH522_patent_ssHA1 [CO1] PolyA | +++ | + |
| 366 | CTH522_patent_ssHA1 [CO2] PolyA | +++ | + |
| 367 | CTH522_patent_ssHA1_Glycneg [CO1] PolyA | +++ | + |

Methods

HeLa cells were plated in 12-well plates at 0.15 million cells/well in 1 mL EMEM+10% FBS. Cells were transfected the next day with 1 μg/well Chlamydia mRNA constructs with lipofectamine 2000.

Preparation of Lysates

Cells were harvested the 22-24 hours later and lysed in 250 μL per well of CelLytic M+1×HALT. Lysates were incubated on ice for 10 minutes then cleared in a microcentrifuge at max speed for 10 min at 4° C. 15 μL Lysate was combined with 5 μL NuPAGE LDS Sample buffer with reducing agent. Reduced samples were incubated at 85° C. for 5 minutes.

Preparation of Supernatant Samples

Supernatants were harvested the 22-24 hours after transfection. 15 μL supernatant was combined with 5 μL NuPAGE LDS Sample buffer with reducing agent. Reduced samples were incubated at 85° C. for 5 minutes.

Analysis

The resulting lysate or supernatant samples were run on 8-16% Gradient SDS-PAGE at 185V for 60 minutes. Protein was transferred to nitrocellulose membrane. Blots were blocked with Intercept blocking buffer overnight at 4° C. Blots were stained with anti-*Chlamydia trachomatis* MOMP polyclonal antibody (for full-length MOMP constructs, T cell constructs, B cell constructs and control constructs), anti-CT443 polyclonal sera (for CT443 constructs), anti-CT584 polyclonal sera (for CT584 constructs), anti-CT600 polyclonal sera (for CT600 constructs) or anti-CT812 polyclonal sera (for CT812 constructs). Antibody staining was done in Intercept Blocking buffer+0.2% Tween 20 for 2 hrs at room temperature (RT). Blots were washed with TBST 3×5 minutes. Blots stained with anti-*Chlamydia trachomatis* MOMP polyclonal antibody were then stained with donkey anti-goat 800 secondary antibody in Intercept Blocking buffer+0.2% Tween 20 for 1 hr at RT. Blots stained with anti-CT443, anti-CT584, anti-CT600 or anti-CT812 polyclonal sera were then stained with donkey anti-rabbit 800 secondary antibody in Intercept Blocking buffer+0.2% Tween 20 for 1 hr at room temperature. Blots were washed with TBST 4×5 minutes. Blots were scanned on Licor odyssey.

Example 3—Recombinant Protein Expression in *E. coli*

DNA constructs encoding Ct antigens were cloned into a T7 promoter-based expression vector for expression in *E. coli* using standard methods. *E. coli* (BL21 DE3) were transformed with the vector. Protein expression was induced with IPTG. The constructs were purified from inclusion bodies using nickel chelation chromatography, followed by protein refolding using the buffers outlined in Table 5.

TABLE 5

Constructs and composition of refolding buffers used for each construct

| Construct | Refolding buffer |
|---|---|
| MOMP_P5_6his_coli (encoding protein of SEQ ID NO: 133) | 50 mM Tris-HCl, 150 mM NaCl, 10% Glycerol, 0.2% SDS, pH 8.0 |
| MOMP_SerE_FL_Wt (encoding protein of SEQ ID NO: 134) | Refolding buffer containing 0.1% NLS detergent |
| MOMP_serE_FL_C2S_6his_coli (encoding protein of SEQ ID NO: 136) | 20 mM Tris, 150 mM NaCl, 0.1% NLS |
| CT443_6his_coli (encoding protein of SEQ ID NO: 143) | PBS, 10% Glycerol, 500 mM NaCl, pH 7.4 |
| 6his_CT584_coli (encoding protein of SEQ ID NO: 145) | 20 mM Tris, 150 mM NaCl, 0.1% NLS |
| 6his_CT600_coli (encoding protein of SEQ ID NO: 146) | PBS, 0.2% NLS, pH 7.4 |
| CT812_ext-pass-domain_6his_coli (encoding protein of SEQ ID NO: 147) | PBS, 10% Glycerol, 0.2% Sodium Lauroyl Sarcosine, pH 7.4 |

The purified constructs were analysed using SDS-PAGE gel electrophoresis under reducing conditions. Western blotting using an anti-His tag antibody was performed for all the constructs except MOMP_serE_FL, and in each case detected the expressed product at the expected molecular weight on the blot. SDS-PAGE under non-reducing conditions indicated that MOMP_serE_FL adopts a trimeric form. Construct stability and conformation were assessed by differential scanning calorimetry (DSC), and secondary structure was assessed using circular dichroism (CD).

Example 4—Immunisation with MOMP mRNA Constructs Elicits Cross-Serovar T Cell Responses in Mice Selected mRNA constructs encoding a native SS-MOMP delivering wild type (WT) full-length MOMP ("mRNA MNR MOMP E FL"; encoding protein of SEQ ID NO: 155) and MOMP without variable domains VD2 and VD4 ("mRNA UNR MOMP E DII:IV"; encoding protein of SEQ ID NO: 157) were tested for their ability to elicit T cell responses. SS-MOMP=native secretion signal sequence of Ct MOMP (SEQ ID NO: 192). As used herein, MNR=modified mRNA (in which all uridine nucleosides were replaced with 1-methyl pseudo uridine). UNR=unmodified mRNA (containing unmodified uridine nucleosides). As used herein in the examples, modified mRNAs (or MNRs) have the nucleic acid sequence as indicated by the SEQ ID NO wherein all uridine nucleosides have been replaced with 1-methylpseudouridine.

In the "mRNA UNR MOMP E DII:IV" construct, nucleic acid sequences encoding variable loops VD2 and VD4 were replaced with sequences encoding non-native loop motifs containing exclusively glycine residues, in order to remove any immunogenic epitopes contained within the loops.

Mice received two immunisations of the SS-MOMP constructs (2 g dose), formulated with the LNP OF-02, given by IM route, at 0 and 3 weeks (W0 and W3). Two additional groups were injected with the "mRNA MNR MOMP E FL" construct according to the same methods but at 0.5 µg and 0.125 µg doses, respectively. 10 mice per group were immunised in each group. Studies included two negative controls: PBS (5 mice) or empty LNP OF-02 (10 mice). Splenocytes were collected fourteen days post-boost. The T specific cellular response was assessed by ELISPOT/FluoroSpot and by Intra cellular cell staining (ICCS).

LNP OF-02 ("Lipid A")=cationic lipid OF-02 at a molar ratio of 40%; DMG-PEG2000 at a molar ratio of 1.5%; cholesterol at a molar ratio of 28.5%; and DOPE at a molar ratio of 30%

Ability to Elicit IFNγ-Producing T Cells (FluoroSpot)

First, ability to elicit IFNγ-producing T cells was tested using FluoroSpot. For the FluoroSpot assay, spleen cells ($0.2 \times 10^6$ per well) were plated in 200 µl RPMI complete together with and without MOMP peptide pools from serovar D, E and F in presence of IL2 (Roche) in triplicate cultures each. The overlapping peptide pools used herein for restimulation consisted of 15-residue peptides covering the entire native protein sequence of interest with 11-residue overlaps between consecutive peptides. Subsequently, plates were incubated at 37° C., 5% $CO_2$ for 20 h. After washing with PBS; plates were incubated with detection Ab anti-IFNγ (mAb R4-6A2-BAM) for 2 h at RT. Image analysis of FluoroSpot assays was performed on Microvision Reader.

To assess the antigen specific response in an ELISPOT/FluoroSpot assay as described herein the number of cytokine producing spots are assessed after either incubation with a specific antigen (peptide, protein, whole bacteria) or no antigen. The average number of cytokine forming spots detected after an incubation with no antigen is considered the assay negative control and this typically very small number of spots is subtracted from the number of cytokine forming spots formed after the different antigen stimulations. This is how the ELISPOT/FluoroSpot data is normalized. Thus, in an ELISPOT/FluoroSpot assay as described herein cells are plated together with and without peptide pools, assessing both the response to antigen stimulation (with peptide pools) and no antigen stimulation (without peptide pools). The "without" peptide data are used to normalize the antigen specific data shown in the corresponding Figures.

As shown in FIG. 1, both "mRNA MNR MOMP E FL" and "mRNA UNR MOMP E DII:IV" (2 µg) were able to induce a comparable level of cross-serovar-responsive IFNγ-producing T cells, suggesting that the T cell response is maintained despite removal of VD loops. Responses were dose-dependent, with little observable difference between 2 µg and 0.5 µg. A 0.125 µg dose was therefore used in later studies comparing mRNA constructs.

Ability to Elicit CD4+ IFNγ+ and CD8+ IFNγ+ T Cell Responses (ICCS)

The MOMP mRNA constructs were also tested for their ability to elicit CD4+ IFNγ+ T cells and CD8+ IFNγ+ T cells in mice that are reactive across various serovars.

For ICCS, isolated lymphocytes were activated with specific serovar E- and F MOMP peptide pools (as described above) at $1 \times 10^6$ cells/well in 96-well plates and cultured for 6 h in 5% $CO_2$ at 37° C. with BFA in order to block cytokine secretion. Activated cells were harvested for surface and intracellular cytokine staining. Surface staining of the cells was performed by incubating with fluorescent conjugated monoclonal antibodies specific to CD3, CD4, and CD8 for 20 min on ice. After surface staining, the cells were washed two times, fixed and permeabilized for 20 min at 4° C. using BD Cytofix/Cytoperm buffer (BD Biosciences) and washed twice with the BD Perm/Wash buffer. Intracellular cytokine staining was then performed by incubating with the fluorescent conjugate antibodies against murine IL-2, IL-5, IL-10, TNF-α, and IFN-γ on ice for 30 min. The cells were washed three times and analyzed with a FACS Fortessa flow cytometer (BD Biosciences).

As shown in FIG. 2A, both "mRNA MNR MOMP E FL" and "mRNA UNR MOMP E DII:IV" (2 µg) were able to induce cross-serovar-responsive CD4+ IFNγ+ T cells. Responses for "mRNA MNR MOMP E FL" (tested at multiple doses) were dose-dependent.

As shown in FIG. 2B, "mRNA MNR MOMP E FL" induced cross-serovar-responsive CD8+ IFNγ+ cells in a dose-dependent manner. "mRNA UNR MOMP E DII:IV" (2 µg dose) elicited minimal CD8+ IFNγ+ T cell responses.

Thus, removal of VD loops may elevate CD4+ IFNγ+ T cell responses.

Example 5—Immunisation with MOMP mRNA Elicits an Immune Response

LNP-formulated constructs (all unmodified mRNAs) were used to immunise mice. 8 mice (Balb/c) were immunised in each study group. The following study groups were assessed (human leader=signal sequence of SEQ ID NO: 191):

Group 1: Naïve—Negative control (LNP (MC3) buffer)
Group 2: UV EB+CpG prime and live boost (First priming immunisation with Ct elementary bodies (EB) ($10^7$ inclusion-forming units (IFU) of UV-inactivated EB)+ 20 µg CpG adjuvant, and second boost immunisation with $10^7$ IFU live Ct serovar E EB+20 µg CpG adjuvant
Group 3: rMOMP (recombinant serovar E MOMP protein) (SEQ ID NO: 134); 50 µg dose+20 µg CpG adjuvant
Group 4: MC3 Ser E MOMP (encoding protein of SEQ ID NO: 148); 5 µg dose
Group 5: MC3 Ser E MOMP (encoding protein of SEQ ID NO: 148); 0.5 µg dose
Group 6: MC3 Ser E MOMP with human leader (encoding protein of SEQ ID NO: 149); 5 µg dose
Group 7: MC3 Ser E MOMP with human leader (encoding protein of SEQ ID NO: 149); 0.5 µg dose
Group 8: OF-02 Ser E MOMP (encoding protein of SEQ ID NO: 151); 5 µg dose
Group 9: OF-02 Ser E MOMP (encoding protein of SEQ ID NO: 151); 0.5 µg dose
Group 10: OF-02 Ser E MOMP with human leader (encoding protein of SEQ ID NO: 152); 5 µg dose
Group 11: OF-02 Ser E MOMP with human leader (encoding protein of SEQ ID NO: 152); 0.5 µg dose Immunisations were given at days 0 and 28, and bleeds were performed at days 0, 14, 28 and 42. Spleens were collected at day 42.

Ability to Elicit IgG that Binds Recombinant MOMP (ELISA)

Figure 3:
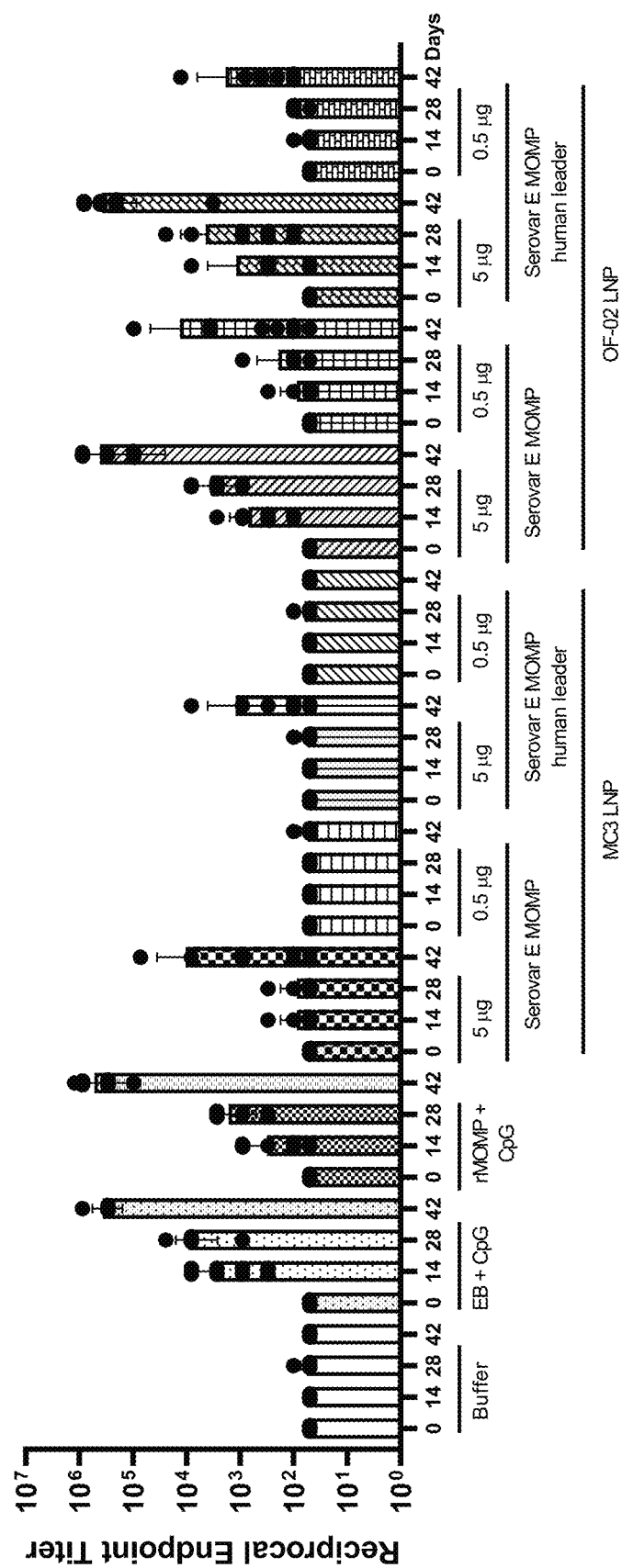
FIG. 3 shows reciprocal dilution IgG titres in mice immunised with LNP-formulated mRNAs encoding recombinant serovar E MOMP, assessed using plate ELISA.

Reciprocal dilution IgG titers were assessed in plate ELISA using recombinant serovar E MOMP. The formulation with OF-02 LNP led to higher titers at day 42 than the formulation with MC3 (FIG. 3). Titers for OF-02-formulated constructs at 5 g were at levels comparable to those of the EB+CpG and rMOMP+CpG controls.

Ability to Elicit IFNγ-Producing T Cells (ELISPOT)

T cell responses were assessed in splenic IFNγ ELISPOT, as shown in FIGS. 4A, B and C. Different recall antigens were used, and are indicated above the individual graphs: "UV EB", which stands for UV inactivated EBs (FIG. 4A), "rMOMP", which is recombinant serovar E MOMP protein (FIG. 4B), and "total peptide pool", which stands for a pool of overlapping serovar E MOMP peptides (as described above) (FIG. 4C).

These data indicate that immunisation with either OF-02 or MC3 formulated WT serovar E MOMP mRNA elicits MOMP specific IFNγ-producing T cells, and these T cells are elicited in response to any of the tested recall antigens.

Example 6—MOMP Constructs Lacking One or More VD Loops Induce a T Cell Response

Further mRNA (UNR) constructs delivering MOMP without variable domains were tested for their ability to elicit T cell responses.

The Removal of the Variable Domains does not Impair the Ability to Elicit an IFNγ MOMP T Cell Response In this example, mice (female C57BL/6) were immunised with MOMP mRNA constructs (containing unmodified mRNA), or a recombinant MOMP control, to test the effects of the systematic removal of variable domain loops VD1, VD2, VD3, VD4 from MOMP serovar E, either alone or in combination. In the ΔVD constructs, nucleic acid sequences were modified so that variable loops were replaced with non-native loop motifs containing glycine residues, in order to remove any immunogenic epitopes contained within the loops. For example, ΔVD1 encodes a serovar E MOMP in which the VD1 loop is replaced by six Gly residues. All of the mRNA constructs also encoded the native signal sequence (of SEQ ID NO: 192), with exception of the Δ-signal-peptide mRNA construct.

Two studies as set out in the tables below (Table 6 and Table 7) were performed, and the data presented in FIGS. 5A and B, respectively show analysis of splenocytes from mice in these groups:

TABLE 6

Figure 5B:
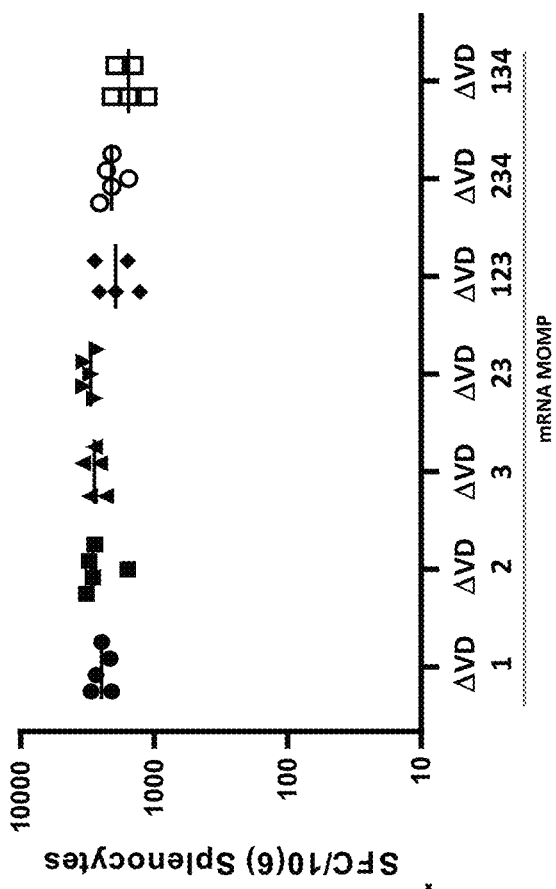
FIGS. 5A-5B show the level of IFNγ production by T cells in mice following immunisation with MOMP mRNA constructs in which one or more variable domain (VD) loops are removed, in response to stimulation with recall antigen (pools of overlapping peptides of serovar E MOMP).
Figure 5A:
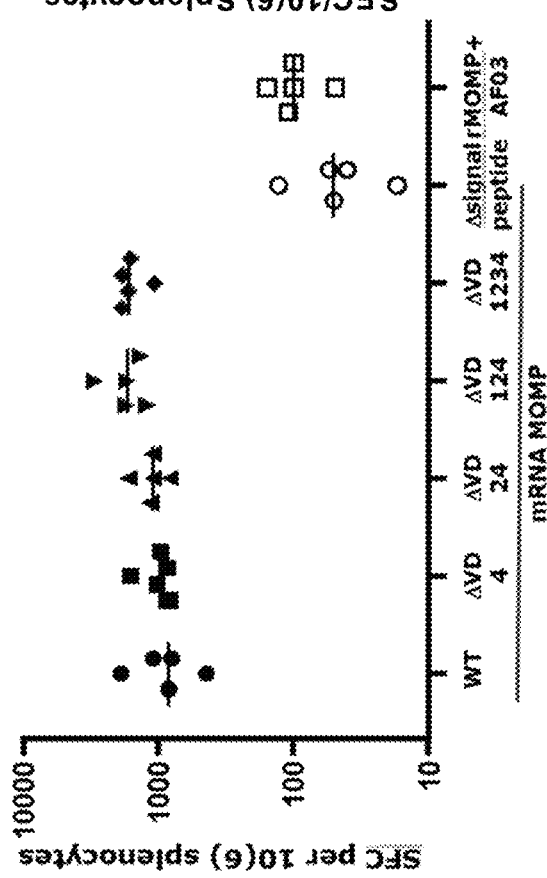

Study groups presented in FIG. 5A

| Group N = 10 | Antigen (mRNA) | Dose (μg) | LNP or Adjuvant | Dosing schedule (days) | Bleeding schedule (days) |
|---|---|---|---|---|---|
| 1 | Wild type MOMP (encoding protein of SEQ ID NO: 154) | 2 | OF-02 | 0, 21 | Pre-immunisation - 1 (Pre-), 21, 34 |
| 2 | ΔVD4 (encoding protein of SEQ ID NO: 156) | 2 | OF-02 | 0, 21 | Pre-, 21, 34 |
| 3 | ΔVD2 ΔVD4 (encoding protein of SEQ ID NO: 157) | 2 | OF-02 | 0, 21 | Pre-, 21, 34 |
| 4 | ΔVD1 ΔVD2 ΔVD4 (encoding protein of SEQ ID NO: 158) | 2 | OF-02 | 0, 21 | Pre-, 21, 34 |
| 5 | ΔVD1234 (encoding protein of SEQ ID NO: 159) | 2 | OF-02 | 0, 21 | Pre-, 21, 34 |
| 6 | Δ-signal-peptide (encoding protein of SEQ ID NO: 160) | 2 | OF-02 | 0, 21 | Pre-, 21, 34 |
| Protein Controls | | | | | |
| 7 | rMOMP (SEQ ID NO: 134) | 5 | AF03 | 0, 21 | Pre-, 21, 34 |

TABLE 7

Study groups presented in FIG. 5B

| Group N = 5 | Antigen (mRNA) | Dose (ug) | LNP or Adjuvant | Dosing schedule (days) | Bleeding schedule (days) |
|---|---|---|---|---|---|
| 1 | ΔVD1 (encoding protein of SEQ ID NO: 161) | 2 | OF-02 | 0, 21 | Pre-, 21, 35 |
| 2 | ΔVD2 (encoding protein of SEQ ID NO: 162) | 2 | OF-02 | 0, 21 | Pre-, 21, 35 |
| 3 | ΔVD3 encoding protein of (SEQ ID NO: 163) | 2 | OF-02 | 0, 21 | Pre-, 21, 35 |
| 4 | ΔVD2 ΔVD3 (encoding protein of SEQ ID NO: 164) | 2 | OF-02 | 0, 21 | Pre-, 21, 35 |
| 5 | ΔVD1 ΔVD2 ΔVD3 (encoding protein of SEQ ID NO: 165) | 2 | OF-02 | 0, 21 | Pre-, 21, 35 |

TABLE 7-continued

Study groups presented in FIG. 5B

| Group N = 5 | Antigen (mRNA) | Dose (ug) | LNP or Adjuvant | Dosing schedule (days) | Bleeding schedule (days) |
|---|---|---|---|---|---|
| 6 | ΔVD2 ΔVD3 ΔVD4 (encoding protein of SEQ ID NO: 166) | 2 | OF-02 | 0, 21 | Pre-, 21, 35 |
| 7 | ΔVD1 ΔVD3 ΔVD4 (encoding protein of SEQ ID NO: 167) | 2 | OF-02 | 0, 21 | Pre-, 21, 35 |

The ELISPOT assay was used to evaluate the T cell response of the mice after intramuscular (IM) injection, by measuring the level of IFNγ production by the T cells collected from the spleens. Spleens from individual mice were collected on the day of the final bleed (34/35) from the mice and T cell responses in splenocytes were assessed by ELISPOT, with pools of overlapping peptides of serovar E MOMP (as described above) used as recall antigen to stimulate the T cell response.

FIGS. 5A and B show the level of IFNγ production by the T cells following immunisation with mRNA constructs and stimulation with recall antigen. The data indicate that removal of the signal sequence eliminates the T cell response.

Immunisation with mRNA encoding MOMP serovar E with one or more of the variable domain loops VD1, VD2, VD3 and VD4 removed, and various combinations thereof, gives rise to a similar, if not enhanced, T cell response to that of FL MOMP serovar E. Therefore, removal of the variable domains does not impair ability to elicit an IFNγ MOMP T cell response.

MOMP without Variable Loops VD2 and VD4 is Able to Elicit an Immune Response

Unmodified (UNR) mRNA encoding MOMP without DII (VD2) and DIV (VD4) domain (DIIDIV), "mRNA UNR MOMP E DII:IV" (encoding protein of SEQ ID NO: 157), was compared to recombinant MOMP protein (SEQ ID NO: 134) for its ability to induce a T cell response. In the "mRNA UNR MOMP E DII:IV" construct, variable loops VD2 and VD4 were replaced with non-native loop motifs containing glycine residues, in order to remove any immunogenic epitopes contained within the loops.

Mice (N=15 in each group) received two immunisations of unmodified (UNR) MOMP deleted of DII and DIV domain (DIIDIV) mRNA native SS-constructs (native sequence signal) ("mRNA UNR MOMP E DII:IV") and recombinant MOMP protein (serE) at 2 and 5 μg dose respectively, formulated with the LNP OF-02 or with a liposome-based adjuvant containing TLR4 agonist (SPA14, as described in WO2022090359) respectively, given by IM route, at 0 and 3 weeks (W0 and W3). A control group (N=15) was injected with PBS. Studies included a negative PBS control. Splenocytes were collected seven, eleven- and fourteen-days post-boost. T specific cellular response was assessed by ELISPOT/FluoroSpot and by ICCS.

Ability to Elicit IFNγ-Producing T Cells (FluoroSpot)

First, ability to elicit IFNγ-producing T cells was tested using FluoroSpot. For the FluoroSpot assay, spleen cells (0.2, 0.5 and 1×10⁶ per well) were plated in 200 μl RPMI complete together with and without MOMP peptide pools (as described above) from serovar E in presence of IL2 (Roche) in triplicate cultures each. Subsequently plates were incubated at 37° C., 5% $CO_2$ for 20 h. After washing with PBS, plates were incubated with detection Ab anti-IFNγ (mAb R4-6A2-BAM) for 2 h at RT. Image analysis of FluoroSpot assays was performed on Microvision Reader.

As shown in FIG. 6A, MOMP DIIDIV UNR mRNA (i.e. "mRNA UNR MOMP E DII:IV") was able to induce a comparable level of IFNγ-producing T cells relative to recombinant MOMP protein as formulated with adjuvant. High levels of IFNγ-producing T cells were observed between these antigens at days 7, 11 and 14. Therefore, removal of the variable domains VD2 and VD4 does not impair ability to elicit an IFNγ MOMP T cell response relative to rMOMP formulated with SPA14 adjuvant.

Ability to Elicit CD4+ IFNγ+ and CD8+ IFNγ+ Cell Responses (ICCS)

The "mRNA UNR MOMP E DII:IV" construct was also compared to recombinant MOMP protein for its ability to elicit CD4+ IFNγ+ cells and CD8+ IFNγ+ cells, using ICCS.

For ICCS, isolated lymphocytes from the D7, D11 and D14 splenocyte samples were activated with specific serovar E-MOMP peptide pool (as described above) at 1 × 10⁶ cells/well in 96-well plates and cultured for 6 h in 5% $CO_2$ at 37° C. with BFA in order to block cytokine secretion. Activated cells were harvested for surface and intracellular cytokine staining. Surface staining of the cells was performed by incubating with fluorescent conjugated monoclonal antibodies specific to CD3, CD4, and CD8 for 20 min on ice. After surface staining, the cells were washed two times, fixed and permeabilized for 20 min at +4° C. using BD Cytofix/Cytoperm buffer (BD Biosciences) and washed twice with the BD Perm/Wash buffer. Intracellular cytokine staining was then performed by incubating with the fluorescent conjugate antibodies against murine IL-2, IL-5, IL-10, TNF-α, and IFNγ on ice for 30 min. The cells were washed three times and analyzed with a FACS Fortessa flow cytometer (BD Biosciences).

As shown in FIG. 6B, across each of the splenocyte samples (collected 7, 11 and 14 days post-boost, respectively), both MOMP DIIDIV UNR mRNA (i.e. "mRNA UNR MOMP E DII:IV") and recombinant MOMP protein were able to elicit the production of CD4+ IFNγ cells. As shown in FIG. 6C, MOMP DIIDIV UNR mRNA also elicited a CD8+ IFNγ cell response, whereas recombinant MOMP protein did not.

In conclusion, the MOMP DIIDIV UNR mRNA, like rMOMP, elicits a significant CD4+ IFNγ cell response. Additionally, it shows a CD8+ IFNγ cell response which is not present for rMOMP.

Example 7—T Cell Constructs Elicit a Strong T Cell Response

T Cell Constructs are Able to Elicit a T Cell Response 7.1 The following mRNA constructs of MOMP variants (including those designed in Example 1; all modified) were formulated in LNP OF-02 and tested for their ability to produce a T cell response:
- MOMP_P3_ssHA1 ("P3") (encoding protein of SEQ ID NO: 53)
- MOMP_P5_ssHA1_C2S ("P5 C2S") (encoding protein of SEQ ID NO: 59)
- MOMP_serE_FL_ssHA1 ("FL") (encoding protein of SEQ ID NO: 29)
- MOMP_serE_FL_ssHA1_C2S_Glycneg ("FL C2S Glycneg") (encoding protein of SEQ ID NO: 35)
- Empty LNP OF-02

Mice received two immunisations of mRNA ssHA1-constructs (comprising sequence signal from hemagglutinin H1N1 A/Caledonia/20/1999; ssHA1 is given by SEQ ID NO: 187) at 0.125 µg dose, formulated with the LNP OF-02, given by IM route, at 0 and 3 weeks (W0 and W3). Studies included a negative empty-LNP control and a positive full-length-MOMP-Serovar E control. Splenocytes were collected two weeks post-boost. A T specific cellular response was assessed by ELISPOT/FluoroSpot and by ICCS.

7.2 In a second study, the following mRNA constructs of MOMP variants (including those designed in Example 1; all modified) were formulated in LNP OF-02 and tested for their ability to produce a T cell response:
- MOMP_P3_ssHA1 ("P3") (encoding protein of SEQ ID NO: 53)
- MOMP_P3_ssHA1_C2S ("P3 C2S") (encoding protein of SEQ ID NO: 55)
- MOMP_P5_ssHA1 ("P5") (encoding protein of SEQ ID NO: 57)
- MOMP_P5_ssHA1_C2S ("P5 C2S") (encoding protein of SEQ ID NO: 59)
- MOMP_serE_FL_ssHA1 ("Ser E FL") (encoding protein of SEQ ID NO: 29)
- MOMP_serD_FL_ssHA1 ("Ser D FL") (encoding protein of SEQ ID NO: 21)
- Empty LNP OF-02

Mice received two immunisations of mRNA ssHA1-constructs (comprising sequence signal from hemagglutinin H1N1 A/Caledonia/20/1999; ssHA1 is given by SEQ ID NO: 187) at 0.125 µg or 2 µg dose, formulated with the LNP OF-02, given by IM route, at 0 and 3 weeks (W0 and W3). Studies included a negative empty-LNP control and positive full-length-MOMP-Serovar E and full-length-MOMP-Serovar D controls. Splenocytes were collected one week post-boost. A T specific cellular response was assessed by ELISPOT/FluoroSpot (0.125 µg dose) and by ICCS (2 µg dose). Results provided in this Example were obtained from the study described in point 7.1, unless indicated otherwise.

Ability to Elicit IFNγ-Producing T Cells and IL-5 Response (FluoroSpot)

First, ability to elicit IFNγ-producing and IL-5 producing T cells was tested using FluoroSpot. For the FluoroSpot assay, spleen cells ($2\times10^5$ per well) were plated in 200 µl RPMI complete together with and without MOMP peptide pools (as described above) from serovar D, E, F, G and J (left to right/light grey to dark grey, respectively in FIGS. 7-8) in the presence of IL2 (Roche) and in triplicate cultures. Subsequently, plates were incubated at 37° C., 5% $CO_2$ for 20 h. After washing with PBS, plates were incubated with detection Ab anti-IFNγ (mAb R4-6A2-3AM), or detection Ab anti-IL-5 (mAb TRFK4, biotin) for 2 h at RT. Image analysis of FluoroSpot assays was performed on Microvision Reader.

Figure 7:
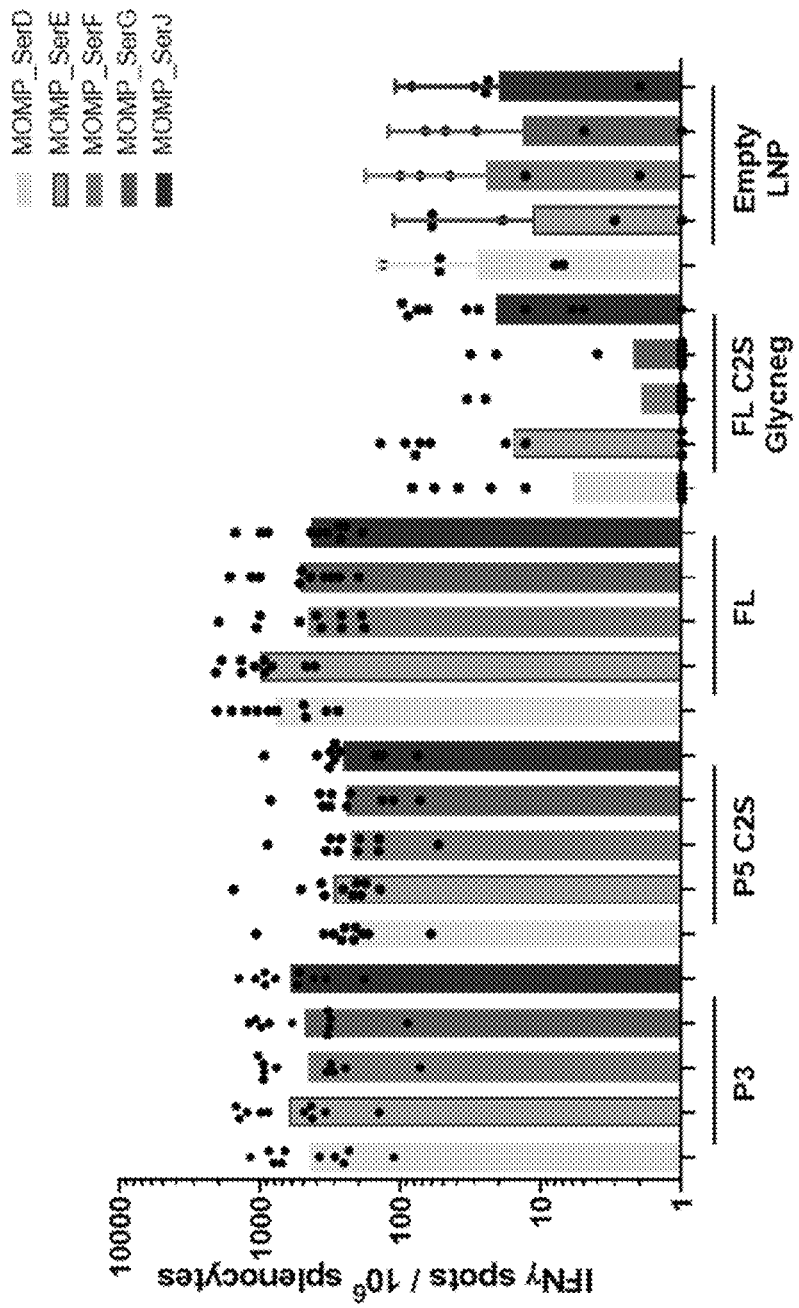
FIG. 7 shows the induction of cross-serovar-responsive IFNγ-producing T cells in mice following immunisation with mRNAs encoding modified MOMP polypeptide antigens in which VD loops have been removed (MOMP_P3_ssHA1 ("P3"), MOMP_P5_ssHA1_C2S ("P5 C2S")), or full-length MOMP constructs MOMP_serE_FL_ssHA1 ("FL"), MOMP_serE_FL_ssHA1_C2S_Glycneg ("FL C2S Glycneg"). Recall antigens were overlapping peptides of MOMP serovar D, E, F, G or J.

As shown in FIG. 7, MOMP_P3_ssHA1 ("P3") and MOMP_P5_ssHA1A_C2S ("P5 C2S"), like MOMP_serE_FL_ssHA1 ("FL"), gave rise to high numbers of cross-serovar-responsive IFNγ-producing T cells. In contrast, MOMP_serE_FL_ssHA1_C2S_Glycneg ("FL C2S Glycneg") did not elicit a level of cross-serovar-responsive IFNγ-producing T cell response above that of empty LNPs.

Figure 8:
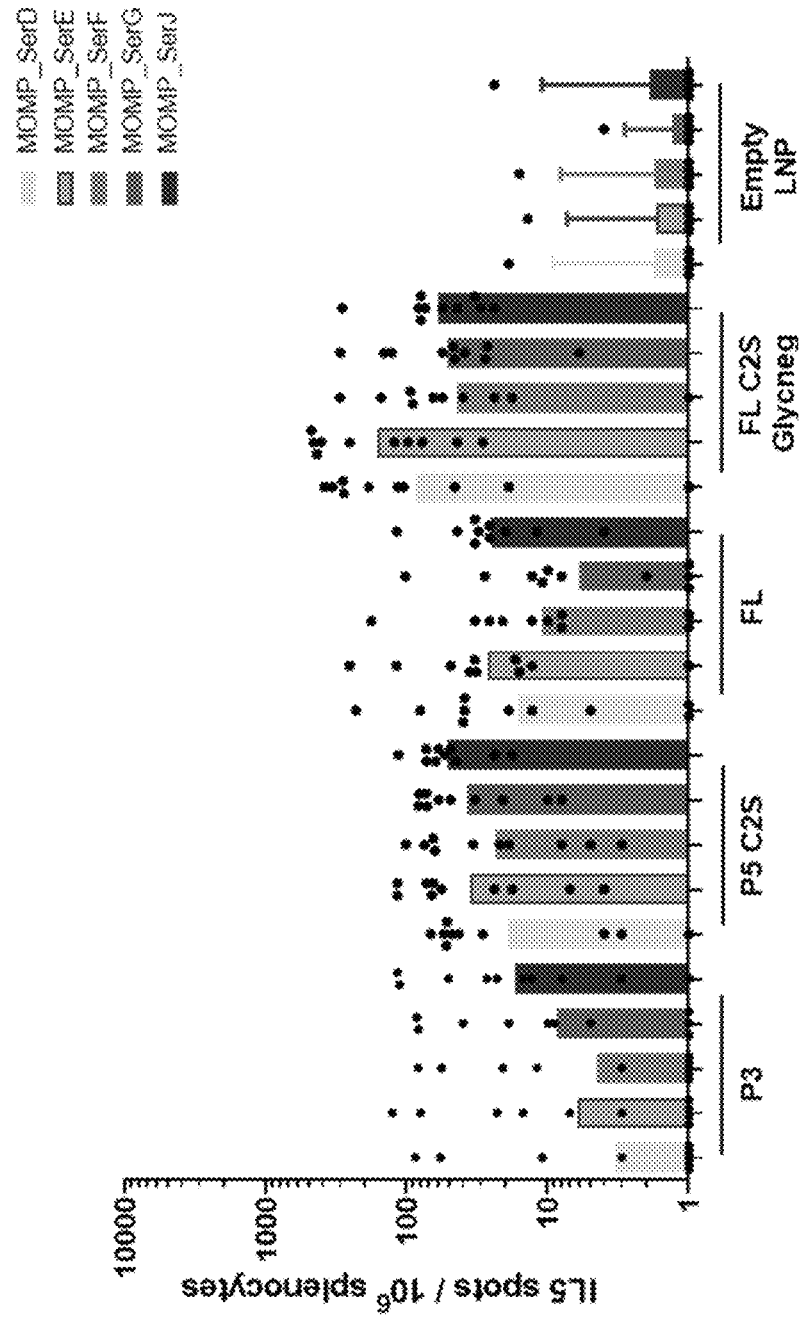
FIG. 8 shows induction of cross-serovar-responsive IL-5-producing T cells in mice following immunisation with MOMP_P3_ssHA1 ("P3"), MOMP_P5_ssHA1_C2S ("P5 C2S"), MOMP_serE_FL_ssHA1 ("FL"), or MOMP_serE_FL_ssHA1_C2S_Glycneg ("FL C2S Glycneg"). Recall antigens were overlapping peptides of MOMP serovar D, E, F, G or J.

As shown in FIG. 8, all of the immunisation samples (MOMP_P3_ssHA1 ("P3"), MOMP_P5_ssHA1_C2S ("P5 C2S"), MOMP_serE_FL_ssHA1 ("FL"), MOMP_serE_FL_ssHA1_C2S_Glycneg ("FL C2S Glycneg") and empty LNP) induced low levels of cross-serovar-responsive IL-5-producing cells, indicating a minimal Th2 response.

mRNA constructs evaluated in the study detailed in section 7.2 were also tested for their ability to elicit IFNγ-producing T cells using the FluoroSpot assay described above with plating of $1\times10^5$ spleen cells per well.

Figure 9A:
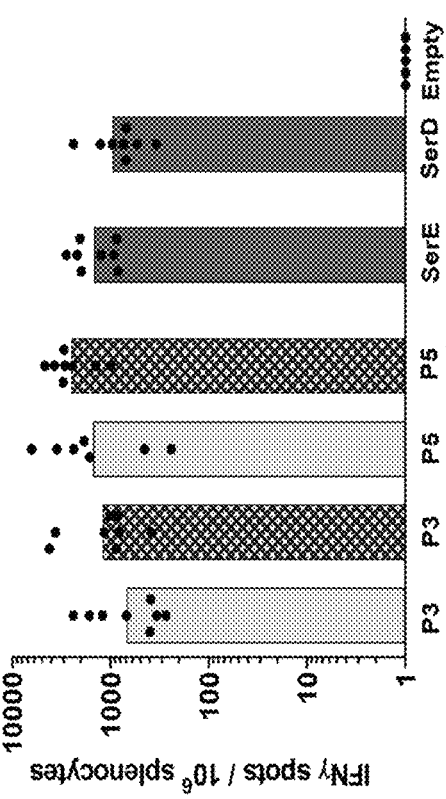
FIGS. 9A-9B show the induction of cross-serovar-responsive IFNγ-producing T cells in mice following immunisation with mRNAs encoding modified MOMP polypeptide antigens in which VD loops have been removed (MOMP_P3_ssHA1 ("P3"), MOMP_P3_ssHA1_C2S ("P3 C2S"), MOMP_P5_ssHA1 ("P5"), MOMP_P5_ssHA1_C2S ("P5 C2S")), or full-length MOMP constructs MOMP_serE_FL_ssHA1 ("SerE FL"), MOMP_serD_FL_ssHA1 ("SerD FL") according to the study detailed in 7.2. Recall antigens were overlapping peptides of (FIG. 9A) MOMP serovar E or (FIG. 9B) MOMP serovar D, F, G or J.
Figure 9B:
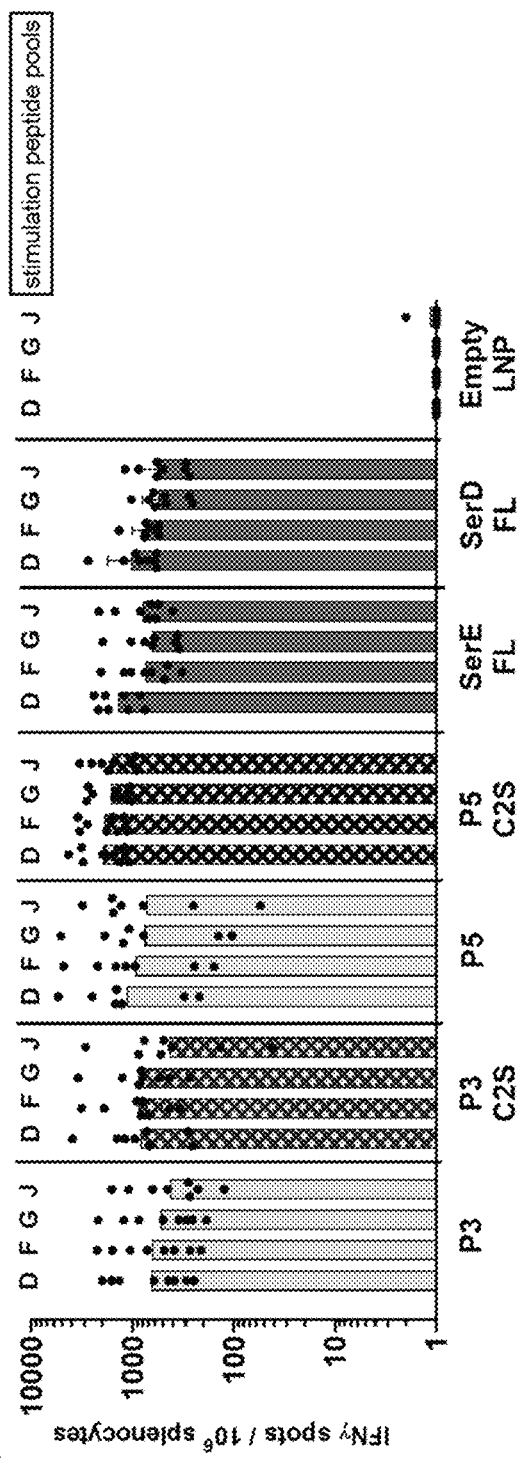

As shown in FIG. 9, all mRNA constructs tested in the study detailed in section 7.2 gave rise to high numbers of cross-serovar-responsive IFNγ-producing T cells.

Ability to Elicit CD4+ IFNγ+, CD8+ IFNγ+, and Polyfunctional Cell Responses (ICCS)

The MOMP mRNA constructs were also tested for their ability to elicit CD4+ IFNγ+ cells, CD8+ IFNγ+ cells and polyfunctional cells in mice.

For ICCS, isolated lymphocytes were activated with specific serovar E-MOMP peptide pool (as described above) at $1\times10^6$ cells/well in 96-well plates and cultured for 6 h in 5% $CO_2$ at 37° C. with BFA in order to block cytokine secretion. Activated cells were harvested for surface and intracellular cytokine staining. Surface staining of the cells was performed by incubating with fluorescent conjugated monoclonal antibodies specific to CD3, CD4, and CD8 for 20 min on ice. After surface staining, the cells were washed two times, fixed and permeabilized for 20 min at +4° C. using BD Cytofix/Cytoperm buffer (BD Biosciences) and washed twice with the BD Perm/Wash buffer. Intracellular cytokine staining was then performed by incubating with the fluorescent conjugate antibodies against murine IL-2, IL-5 or IL-17, IL-10, TNF-α, and IFNγ on ice for 30 min. The cells were washed three times and analyzed with a FACS Fortessa flow cytometer (BD Biosciences).

As shown in FIG. 10A, MOMP_P3_ssHA1 ("P3") and MOMP_P5_ssHA1_C2S ("P5 C2S"), like MOMP_serE_FL_ssHA1 ("FL"), gave rise to significant CD4+ IFNγ T cell responses. In contrast, MOMP_serE_FL_ssHA1_C2S_Glycneg ("FL C2S Glycneg") did not give rise to a CD4+ IFNγ T cell response that was distinguishable from the empty LNP control.

As shown in FIG. 10B, CD8+ IFNγ T cell responses were absent or much lower for the tested constructs.

Figure 12:
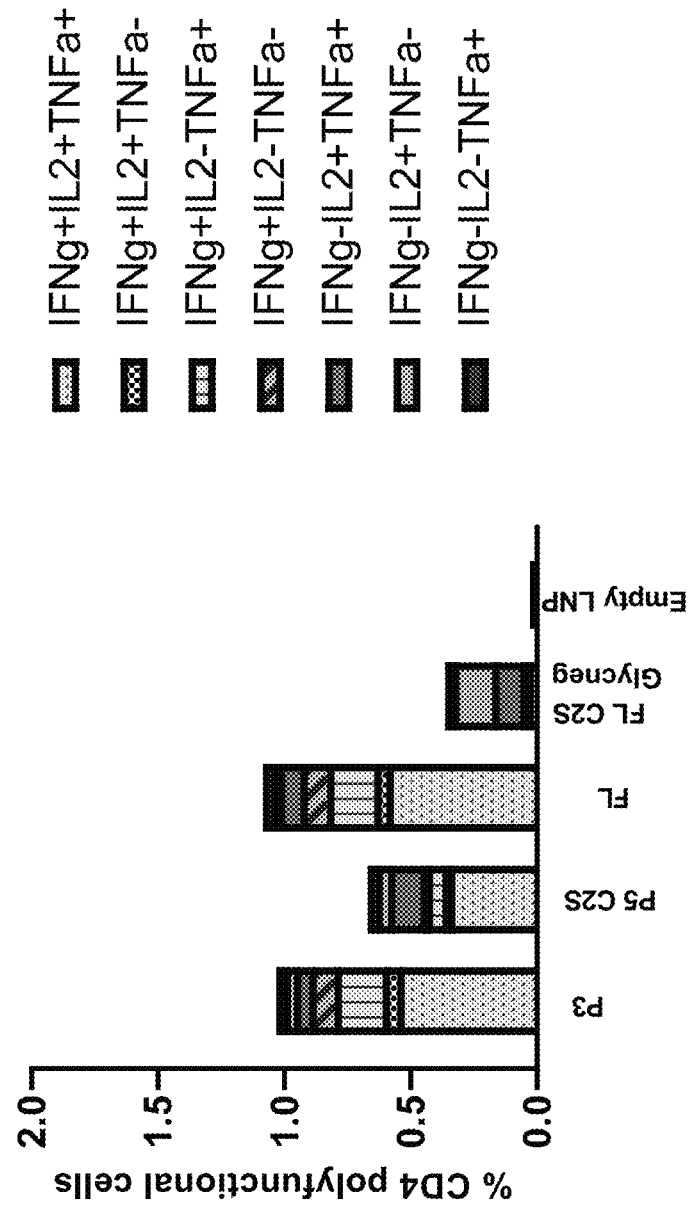
FIG. 12 shows the percentage of CD4+ T cells in mice that produce IFNγ ("IFNg"), IL2 and/or TNFα ("TNFα") (singularly and in the various combinations thereof), after mice are immunised with MOMP_P3_ssHA1 ("P3"), MOMP_P5_ssHA1_C2S ("P5 C2S"), MOMP_serE_FL_ssHA1 ("FL"), or MOMP_serE_FL_ssHA1_C2S_Glycneg ("FL C2S Glycneg").

The MOMP mRNA constructs were also assessed for their ability to induce polyfunctional cells. FIG. 12 shows, for each of the mRNA constructs, the percentage of MOMP-specific CD4+ T cells that were elicited and indicates the relative percentages of CD4+ T cells producing each of IFNγ ("IFNg"), IL2, and/or TNFα (singularly and in the various combinations thereof). For each of MOMP_P3_ssHA1 ("P3"), MOMP_P5_ssHA1_C2S ("P5 C2S") and MOMP_serE_FL_ssHA1 ("FL"), the CD4+ IFNγ+IL2+TNFα+ cell population formed the majority, relative to the other cell populations. Little to no IL5 or IL10 was observed for any of the tested constructs (data not shown).

The MOMP mRNA constructs evaluated in the study described in section 7.2, were similarly tested for their ability to elicit MOMP-specific CD4+ IFNγ+ cells, CD8+ IFNγ+ T cells and polyfunctional cells in mice.

Figure 11A:
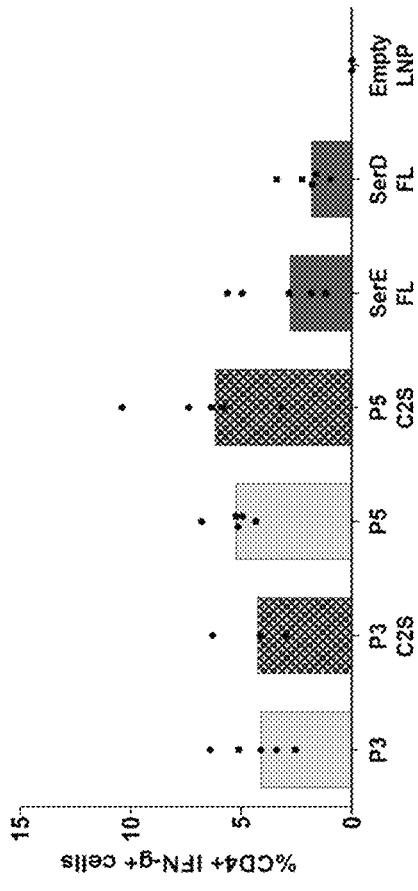
FIGS. 11A-11B show induction in mice of (FIG. 11A) CD4+ IFNγ T cell responses and (FIG. 11B) CD8+ IFNγ T cell responses following immunisation with MOMP_P3_ssHA1 ("P3"), MOMP_P3_ssHA1_C2S ("P3 C2S"), MOMP_P5_ssHA1 ("P5"), MOMP_P5_ssHA1_C2S ("P5 C2S"), or full-length MOMP constructs MOMP_serE_FL_ssHA1 ("SerE FL"), MOMP_serD_FL_ssHA1 ("SerD FL") according to the study detailed in 7.2.
Figure 11B:
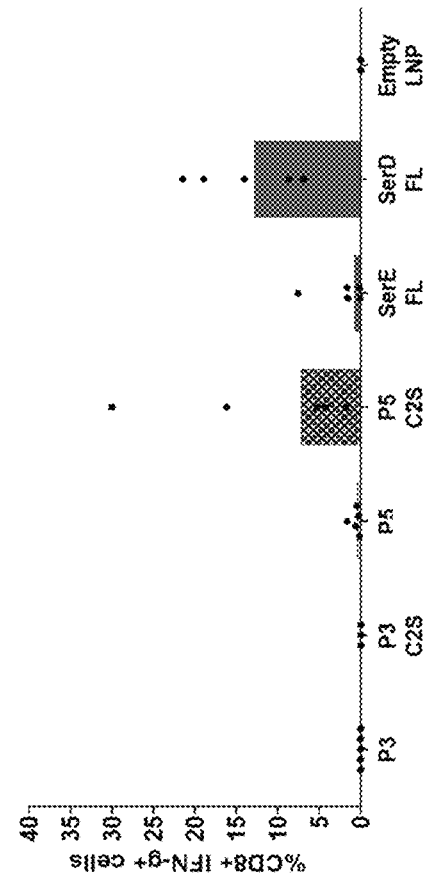

As shown in FIG. 11A, all MOMP mRNA constructs gave rise to a significant CD4+ IFNγ T cell response that was distinguishable from the empty LNP control. The CD4+ IFNγ T cell response was slightly higher for MOMP_P3_ssHA1 ("P3"), MOMP_P5_ssHA1 ("P5"), MOMP_P3_ssHA1_C2S ("P3 C2S"), and MOMP_P5_ssHA1_C2S ("P5 C2S") as compared to the full length MOMP mRNA constructs.

As shown in FIG. 1B, CD8+ IFNγ T cell responses were absent or much lower for the tested constructs, with the exception of the MOMP_P5_ssHA1_C2S ("P5 C2S") and MOMP_serD_FL_ssHA1 ("SerD FL") constructs.

Figure 13:
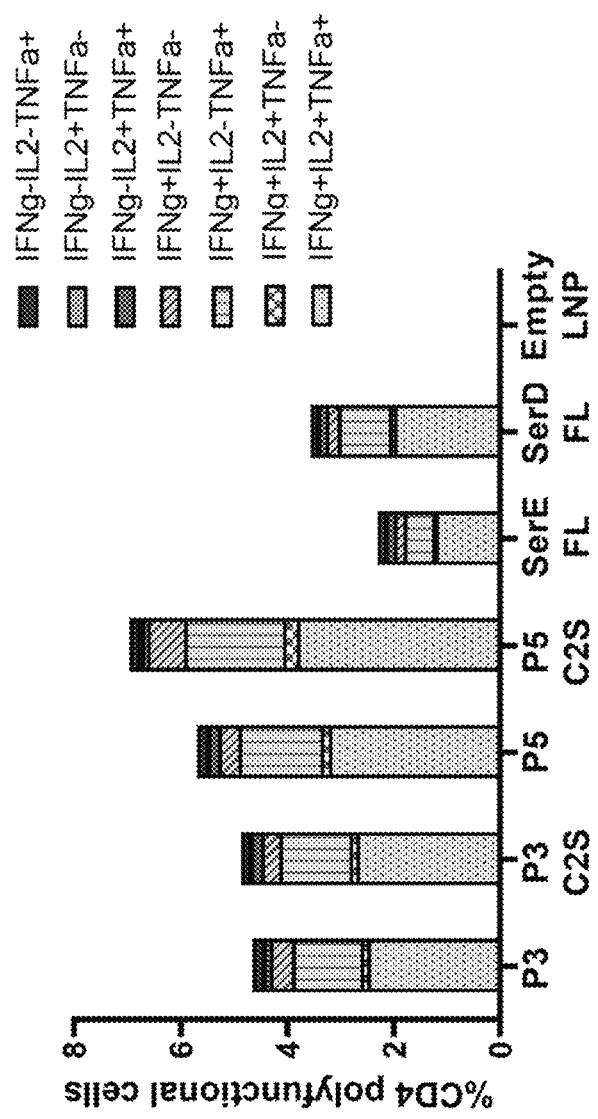
FIG. 13 shows the percentage of CD4+ T cells in mice that produce IFNγ ("IFNg"), IL2 and/or TNFα ("TNFα") (singularly and in the various combinations thereof), after mice are immunised with MOMP_P3_ssHA1 ("P3"), MOMP_P3_ssHA1_C2S ("P3 C2S"), MOMP_P5_ssHA1 ("P5"), MOMP_P5_ssHA1_C2S ("P5 C2S"), or full-length MOMP constructs MOMP_serE_FL_ssHA1 ("SerE FL"), MOMP_serD_FL_ssHA1 ("SerD FL") according to the study detailed in 7.2.

The MOMP mRNA constructs evaluated in the study described in section 7.2, were also assessed for their ability to induce polyfunctional cells. FIG. 13 shows, for each of the MOMP mRNA constructs, the percentage of MOMP-specific CD4+ T cells that were elicited and indicates the relative percentages of CD4+ T cells producing each of IFNγ ("IFNg"), IL2, and/or TNFα (singularly and in the various combinations thereof). For all of the MOMP mRNA constructs tested, the CD4+ IFNγ+IL2+ TNFα+ cell population formed the majority, relative to the other cell populations. Little to no IL-17 or IL-10 was observed for any of the tested constructs (data not shown).

T Cell Constructs Elicit Low Levels of rMOMP Binding Antibodies

The MOMP mRNA constructs were also evaluated to determine if they elicited recombinant MOMP (rMOMP) binding antibodies. Blood samples were collected at 0 weeks (W0) and one week after the last vaccine administration, according to the protocol described in section 7.2 above, in order to measure total IgG by ELISA. The specific IgG were measured from individual sera using automated 384 ELISA.

Briefly, 384-well micro-plates were coated in carbonate buffer with 20 μL per well recombinant MOMP protein at 2 μg/mL and kept overnight at +4° C. Coating solution was removed and washed with buffer 1 (PBS/Tween 0.05%). Free sites were blocked with 75 μL of buffer 2 (PBS/Tween 20 at 0.05%/milk 1%) and incubated 90 min at room temperature (RT). Plates were emptied, then sera were serially diluted in buffer 2 under a volume of 20 μL (12 times) in the microplates. The plates were incubated for 90 min at RT and then washed with buffer 1. 20 μl of a diluted anti-mouse total IgG peroxidase conjugate (Southern Biotech) was added in each well (½000). After 90 min incubation at RT, the plates were washed with buffer 1. The reaction was developed by adding 20 μL of a tetramethylbenzidine substrate solution in each well. The reaction was chemically stopped after 30 min at RT with HCl (IN (normality)) and absorbance was measured at 450-650 nm on a spectrophotometer (Synergy HTX, Biotek). The results were analysed in Softmax Pro software using a standard curve and expressed in arbitrary ELISA units by the reciprocal dilution corresponding to an OD of 1.

Figure 14:
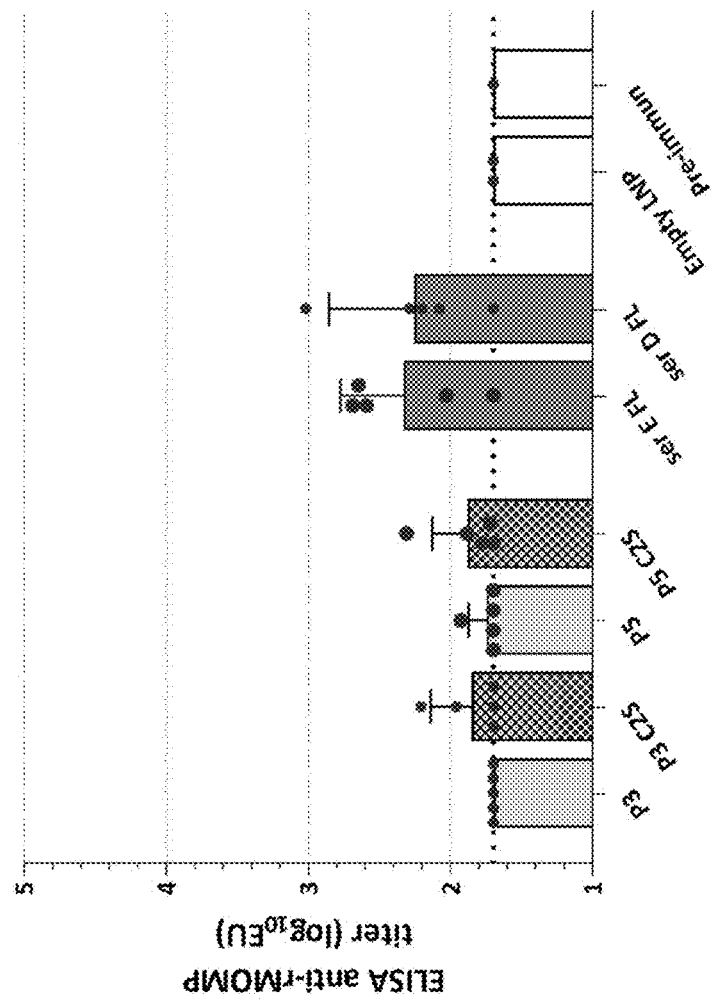
FIG. 14 shows levels of IgG binding to recombinant MOMP (rMOMP) protein, as measured using ELISA, following immunisation of mice with MOMP_P3_ssHA1 ("P3"), MOMP_P3_ssHA1_C2S ("P3 C2S"), MOMP_P5_ssHA1 ("P5"), MOMP_P5_ssHA1 C2S ("P5 C2S"), or full-length MOMP constructs MOMP_serE_FL_ssHA1 ("FL"), MOMP_serD_FL_ssHA1 ("SerD FL") according to the study detailed in 7.2.

As shown in FIG. 14, the MOMP mRNA constructs ("P3", "P3 C2S", "P5", and "P5 C2S") tested elicited low levels of recombinant MOMP binding antibodies. Levels were similar to those observed in pre-immune sera or with empty LNPs, as expected given that these constructs lacked variable domain loops.

Example 8—Immunisation with Non-MOMP Antigens Induces Immune Responses

Non-MOMP Ct Protein Constructs Induce a T Cell Response

Mice (female C57BL/6) were immunised with various Ct non-MOMP recombinant proteins, alongside controls of recombinant MOMP protein or MOMP ΔVD1234 mRNA. The study groups are set out in Table 8 below:

TABLE 8

Study groups

| Group N = 5 | Antigen | Dose (ug) | Administration | Adjuvant | Dosing schedule (days) | Bleeding schedule (days) |
|---|---|---|---|---|---|---|
| 1 | rCT584; SEQ ID NO: 145 | 2 | Subcutaneous (SC) | 10 mg CpG/mouse/ injection + IFA | 0, 21 | Pre-, 21, 37 |
| 2 | rCT812; SEQ ID NO: 197 | 2 | SC | 10 mg CpG/mouse/ injection + IFA | 0, 21 | Pre-, 21, 37 |
| 3 | rCT600; SEQ ID NO: 146 | 2 | SC | 10 mg CpG/mouse/ injection + IFA | 0, 21 | Pre-, 21, 37 |
| 4 | rCT443; SEQ ID NO: 198 | 2 | SC | 10 mg CpG/mouse/ injection + IFA | 0, 21 | Pre-, 21, 37 |
| 5 | Viable EB (E/Bour ATCC VR-348B) | 1e7* | SC | 10 mg CpG/mouse/ injection + IFA | 0, 21 | Pre-, 21, 37 |
| 6 | rMOMP; SEQ ID NO: 134 | 2 | SC | 10 mg CpG/mouse/ injection + IFA | 0, 21 | Pre-, 21, 37 |
| 7 | MOMP ΔVD1234 (UNR mRNA) (encoding protein of SEQ ID NO: 159) | 2 | Intramuscular (IM) | OF-02 | 0, 21 | Pre-, 21, 37 |

The ELISPOT assay was used to evaluate the T cell response of the mice after immunisation, by measuring the level of IFNγ production produced by the T cells collected from the spleens. Spleens from individual mice were collected from the mice and T cell responses in splenocytes were assessed by ELISPOT, with and without pools of overlapping peptides as described above of the relevant specified native MOMP or non-MOMP used as recall antigen to stimulate the T cell response.

Figure 15:
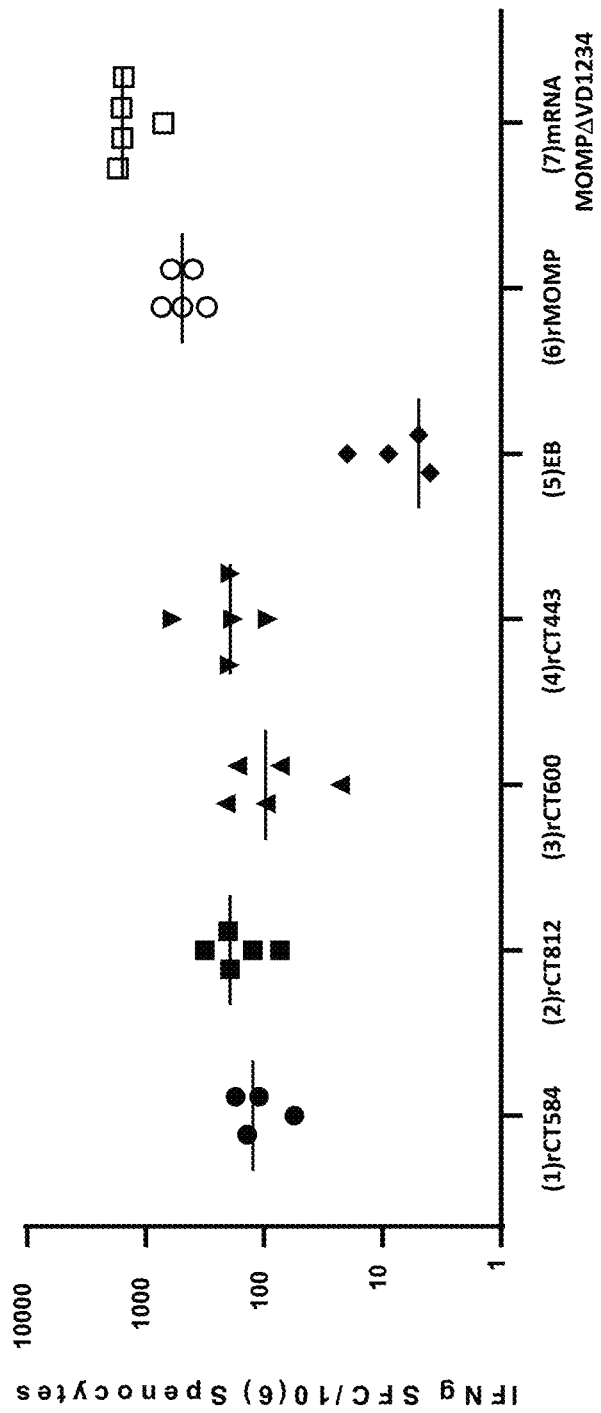
FIG. 15 shows IFNγ T cell responses in mice following immunisation with recombinant (r) non-MOMP polypeptides "rCT584", "rCT812", "rCT600" or "rCT443", recombinant MOMP protein ("rMOMP") or mRNA encoding MOMP serovar E lacking VD loops 1-4 ("mRNA MOMP ΔVD1234"). Pools of overlapping peptides of the respective native MOMP or non-MOMP were used as recall antigens.

As shown in FIG. 15, recombinant (r) non-MOMP proteins "rCT584", "rCT812", "rCT600" and "rCT443" each induce IFNγ-producing T cells at much greater levels than EB. Responses elicited by recombinant MOMP protein ("rMOMP"; SEQ ID NO: 134) and mRNA encoding MOMP serovar E lacking VD loops 1-4 ("mRNA MOMP ΔVD1234") are included for comparison.

mRNA Constructs Encoding Non-MOMP Ct Antigens Induce a T Cell Response

Mice (female C57BL/6) were immunised (IM) with unmodified (UNR) mRNA encoding various Ct non-MOMP antigen fragments alongside the "mRNA MOMP ΔVD1234" construct, formulated in cKK-e10-based LNPs. LNP cKK-e10 ("Lipid B")=cationic lipid cKK-e10 at a molar ratio of 40%; DMG-PEG2000 at a molar ratio of 1.5%; cholesterol at a molar ratio of 28.5%; and DOPE at a molar ratio of 30%.

The study groups are set out in Table 9 below:

TABLE 9

Study groups

| Group N = 5 | Antigen (all unmodified mRNA) | Dose (ug) | LNP | Dosing schedule | Bleeding schedule |
|---|---|---|---|---|---|
| 1 | CT812: 1-1530 (encoding protein of SEQ ID NO: 168) | 2 | cKK-e10 | 0, 21 | Pre-, 21, 35 |
| 2 | CT812: 1-761 (encoding protein of SEQ ID NO: 169) | 2 | cKK-e10 | 0, 21 | Pre-, 21, 35 |
| 3 | Nan96-SS:CT812: 32-761 (encoding protein of SEQ ID NO: 170) | 2 | cKK-e10 | 0, 21 | Pre-, 21, 35 |
| 4 | CT600: 1-188 (encoding protein of SEQ ID NO: 171) | 2 | cKK-e10 | 0, 21 | Pre-, 21, 35 |
| 5 | Nan96-SS:CT600: 2-188 (encoding protein of SEQ ID NO: 172) | 2 | cKK-e10 | 0, 21 | Pre-, 21, 35 |
| 6 | CT443: 1-576 (encoding protein of SEQ ID NO: 173) | 2 | cKK-e10 | 0, 21 | Pre-, 21, 35 |
| 7 | Nan96-SS:CT443: 32-576 (encoding protein of SEQ ID NO: 174) | 2 | cKK-e10 | 0, 21 | Pre-, 21, 35 |
| 8 | MOMP ΔVD1234 (encoding protein of SEQ ID NO: 159) | 2 | cKK-e10 | 0, 21 | Pre-, 21, 35 |

Nan96-SS is the ssHA1 secretion signal given by SEQ ID NO:187. Numbering after the colons indicates the start and end residue (numbering relative to wild-type) of the relevant fragment of each of non-MOMP proteins CT443, CT600, and CT812. In the Nan96-SS constructs, the nucleic acid sequences encoding the ssHA1 secretion signal of SEQ ID NO: 187 and the non-MOMP protein fragment are linked by a nucleic acid sequence encoding the amino acids DTI.

The ELISPOT assay was used to evaluate the T cell response of the mice after immunisation, by measuring the level of IFNγ production produced by the T cells collected from the spleens. Spleens from individual mice were collected from the mice (day 35) and T cell responses in splenocytes were assessed by ELISPOT, with pools of overlapping peptides to the relevant specified MOMP or non-MOMP (as described above) used as recall antigen to stimulate the T cell response.

Figure 16:
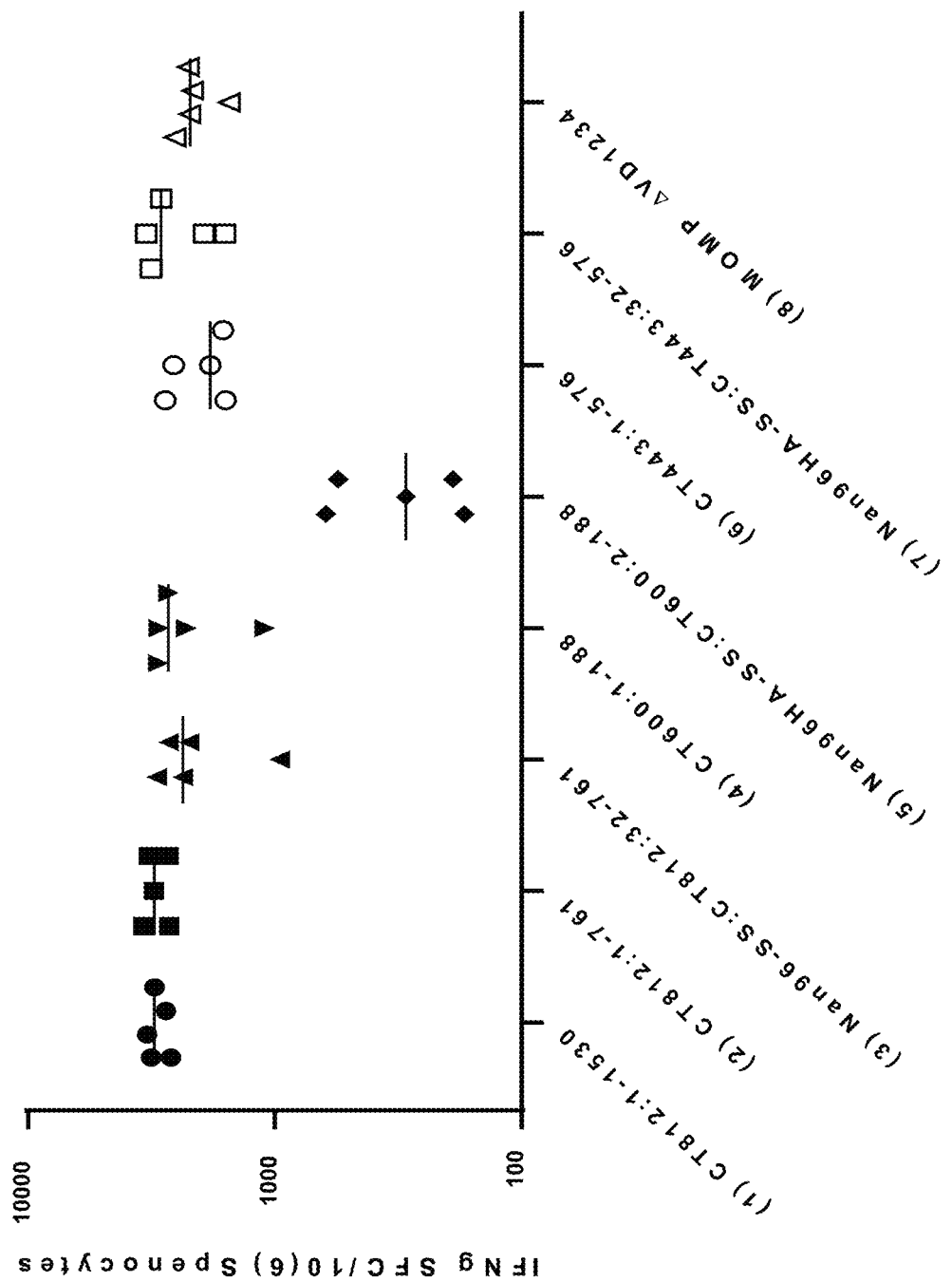
FIG. 16 shows IFNγ T cell responses in mice following immunisation with non-MOMP fragment mRNA constructs (CT812: 1-1530, CT812: 1-761, Nan96-SS:CT812: 32-761, CT600: 1-188, CT443: 1-576, Nan96-SS:CT443: 32-576), or with mRNA encoding MOMP serovar E lacking VD loops 1-4 ("MOMP ΔVD1234"). Pools of overlapping peptides of the respective native MOMP or non-MOMP were used as recall antigens.

As shown in FIG. 16, all of the non-MOMP fragment mRNA constructs (CT812: 1-1530, CT812: 1-761, Nan96-SS:CT812: 32-761, CT600: 1-188, CT443: 1-576, Nan96-SS:CT443: 32-576), gave rise to comparable levels of IFNγ-producing T cells to the mRNA encoding MOMP serovar E lacking VD loops 1-4 ("MOMP ΔVD1234"), with exception of Nan96-SS:CT600: 2-188.

Therefore, various mRNA constructs encoding non-MOMP Ct antigen fragments are also able to elicit a significant IFNγ-producing T cell response.

mRNA Constructs Encoding Non-MOMP Ct Antigens Induce a T Cell Response mRNA encoding non-MOMP Ct antigens "CT443" (Nan96-SS:CT443: 32-576), "CT584" (Nan96HA-SS:CT584:2-183), "CT600" (Nan96HA-SS:CT600:2-188) and "CT812" (Nan96-SS:CT812:32-761) were compared to recombinant MOMP protein for their ability to induce a T cell response.

Mice received two immunisations of unmodified mRNA native signal sequence constructs at 2 g dose, formulated with the cKK-e10-based LNP, given by IM route, at 0 and 3 weeks (W0 and W3). Study included a positive full-length-MOMP-Serovar E recombinant protein control (SEQ ID NO: 134) (5 g)+SPA 14. Splenocytes were collected at days eleven and fourteen post-boost. T specific cellular response was assessed by ELISPOT/FluoroSpot and by ICCS.

Ability to Elicit IFNγ-Producing T Cells (FluoroSpot)

First, ability to elicit IFNγ-producing T cells was tested using FluoroSpot. For the FluoroSpot assay, spleen cells ($2\times10^5$ per well) were plated in 200 μl RPMI complete together with and without respective peptide pools (as described above) in presence of IL2 (Roche) at 0.5 to 2 μg/mL in triplicate cultures each. Subsequently plates were incubated at 37° C., 5% $CO_2$ for 20 h. After washing with PBS, plates were incubated with detection Ab anti-IFNγ (mAb R4-6A2-BAM) for 2 h at RT. Image analysis of FluoroSpot assays was performed on Microvision Reader.

Figure 17:
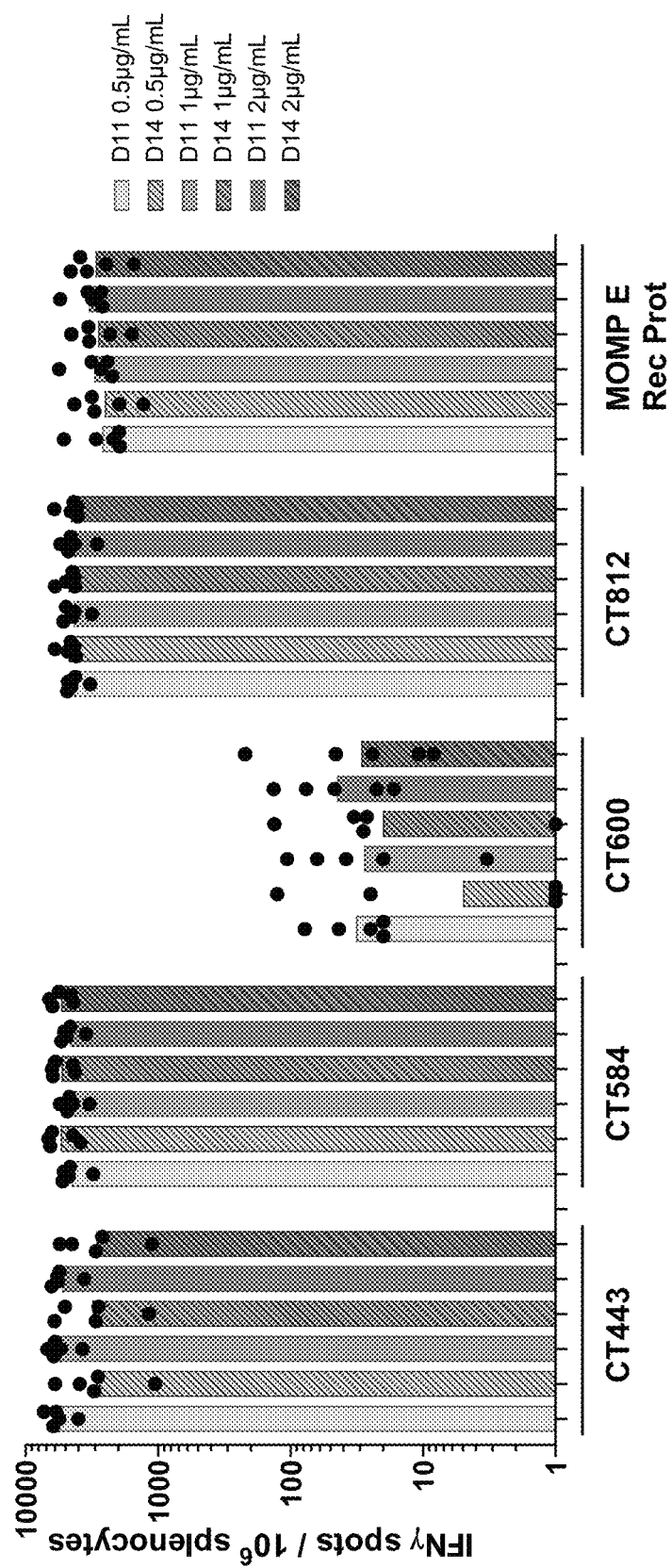
FIG. 17 shows IFNγ T cell responses in mice following immunisation with mRNA encoding non-MOMP Ct antigens "CT443" (Nan96-SS:CT443: 32-576), "CT584" (Nan96HA-SS:CT584:2-183), "CT600" (Nan96HA-SS:CT600:2-188) or "CT812" (Nan96-SS:CT812:32-761), or with recombinant MOMP serovar E protein, in response to stimulation with respective overlapping peptide pools. Responses are shown for splenocytes collected at days eleven (D11) and fourteen (D14) post-boost.

As shown in FIG. 17, mRNA encoding non-MOMP Ct antigens CT443, CT584 and CT812 were, like recombinant MOMP serovar E protein, able to elicit high levels of IFNγ-producing T cells. Responses to mRNA encoding non-MOMP Ct antigen CT600 were lower.

Therefore, various mRNA constructs encoding native non-MOMP Ct antigens (particularly CT443, CT584 and CT812) are able to elicit a strong IFNγ-producing T cell response.

Ability to Elicit CD4+ IFNγ+ and CD8+ IFNγ+ Cell Responses (ICCS)

The same constructs were also tested for their ability to elicit CD4+ IFNγ+ cells and CD8+ IFNγ+ cells in mice.

For ICCS, isolated lymphocytes were activated with specific respective peptide pools (as described above) at $1\times10^6$ cells/well in 96-well plates and cultured for 6 h in 5% $CO_2$ at 37° C. with BFA in order to block cytokine secretion. Activated cells were harvested for surface and intracellular cytokine staining. Surface staining of the cells was performed by incubating with fluorescent conjugated monoclonal antibodies specific to CD3, CD4, and CD8 for 20 min on ice. After surface staining, the cells were washed two times, fixed and permeabilized for 20 min at +4° C. using BD Cytofix/Cytoperm buffer (BD Biosciences) and washed twice with the BD Perm/Wash buffer. Intracellular cytokine staining was then performed by incubating with the fluorescent conjugate antibodies against murine IL-2, IL-5, IL-10, TNF-α, and IFNγ on ice for 30 min. The cells were washed three times and analyzed with a FACS Fortessa flow cytometer (BD Biosciences).

As shown in FIG. 18A, across each of the splenocyte samples (1 or 2 ug doses and collected at 11 or 14 days post-boost), mRNA encoding non-MOMP antigens CT443, CT584, CT600 and CT812 gave rise to a CD4+ IFNγ cell response, but which was lower than that elicited by recombinant MOMP protein.

As shown in FIG. 18B, across each of the splenocyte samples (1 or 2 ug doses and collected at 11 or 14 days post-boost), mRNA encoding non-MOMP antigens CT584 and CT812 elicited high CD8+ IFNγ cell responses relative to CT443, CT600 and recombinant MOMP protein.

Non-MOMP Ct Antigen Constructs are Able to Induce Specific IgG Against their Encoded Proteins In this example, the following mRNA constructs encoding non-MOMP Ct antigens (all modified) were tested for their ability to induce specific IgG against their respective protein: CT443_ssHA1 ("CT443"; encoding protein of SEQ ID NO:105), CT443_ssHA1_GlycNeg ("CT443_GN", encoding protein of SEQ ID NO:106), CT584_ssHA1 ("CT584", encoding protein of SEQ ID NO:107), CT584_ssHA1_Glycneg ("CT584_GN", encoding protein of SEQ ID NO:108), CT584_ssHA1_C2S ("CT584_C2S", encoding protein of SEQ ID NO:109), CT584_ssHA1_Glycneg_C2S ("CT584_GN_C2S", encoding protein of SEQ ID NO:110), CT600_trunc_ssHA1 ("CT600_trunc"; encoding protein of SEQ ID NO: 111), CT600_trunc_ssHA I_Glycneg ("CT600_trunc_GN", encoding protein of SEQ ID NO:112), CT812pass-domain_ssHA1 ("CT812_pass-dom", encoding protein of SEQ ID NO: 113), CT812_pass-domain_ssHA1 C2S ("CT812_pass-dom_C2S", encoding protein of SEQ ID NO: 114), CT812 ext-pass-domain_ssHA1 ("CT812_ext-pass-dom", encoding protein of SEQ ID NO: 115), CT812_ext-pass-domain_ssHA_C2S ("CT812_ext-pass-dom_C2S", encoding protein of SEQ ID NO: 116).

Mice (C57Bl/6) received two immunisations of mRNA constructs at 5 μg dose, formulated with the LNP OF-02, given by IM route, at 0 and 3 weeks (W0 and W3) in at least one of two independent studies. Studies included a negative empty OF-02 LNP control. Blood samples were collected at 0 weeks (W0) and two weeks after the last vaccine administration, in order to measure total IgG by ELISA. The specific IgG were measured from individual sera using automated 384 ELISA.

Briefly, 384-well micro-plates were coated in carbonate buffer with 20 μL per well of respective protein (CT443 (4 μg/mL), CT584 (1 μg/mL), CT600 (4 μg/mL)) and kept overnight at +4° C. Coating solution was removed and washed with buffer 1 (PBS/Tween 0.05%). Free sites were blocked with 75 μL of buffer 2 (PBS/Tween 20 at 0.05%/milk 1%) and incubated 90 min at room temperature (RT). Plates were emptied, then sera were serially diluted in buffer 2 under a volume of 20 μL (12 times) in the microplates. The plates were incubated for 90 min at RT and then washed with buffer 1. 20 μl of a diluted anti-mouse total IgG peroxidase conjugate (Southern Biotech) was added in each well (1/1000). After 90 min incubation at RT, the plates were washed with buffer 1. The reaction was developed by adding 20 μL of a tetramethylbenzidine substrate solution in each well. The reaction was chemically stopped after 30 min at RT with HCl (1N (normality)) and absorbance was measured at 450-650 nm on a spectrophotometer (Synergy HTX, Biotek). The results were analyzed in Softmax Pro software using a standard curve and expressed in arbitrary ELISA units by the reciprocal dilution corresponding to an OD of 1.

Figure 19:
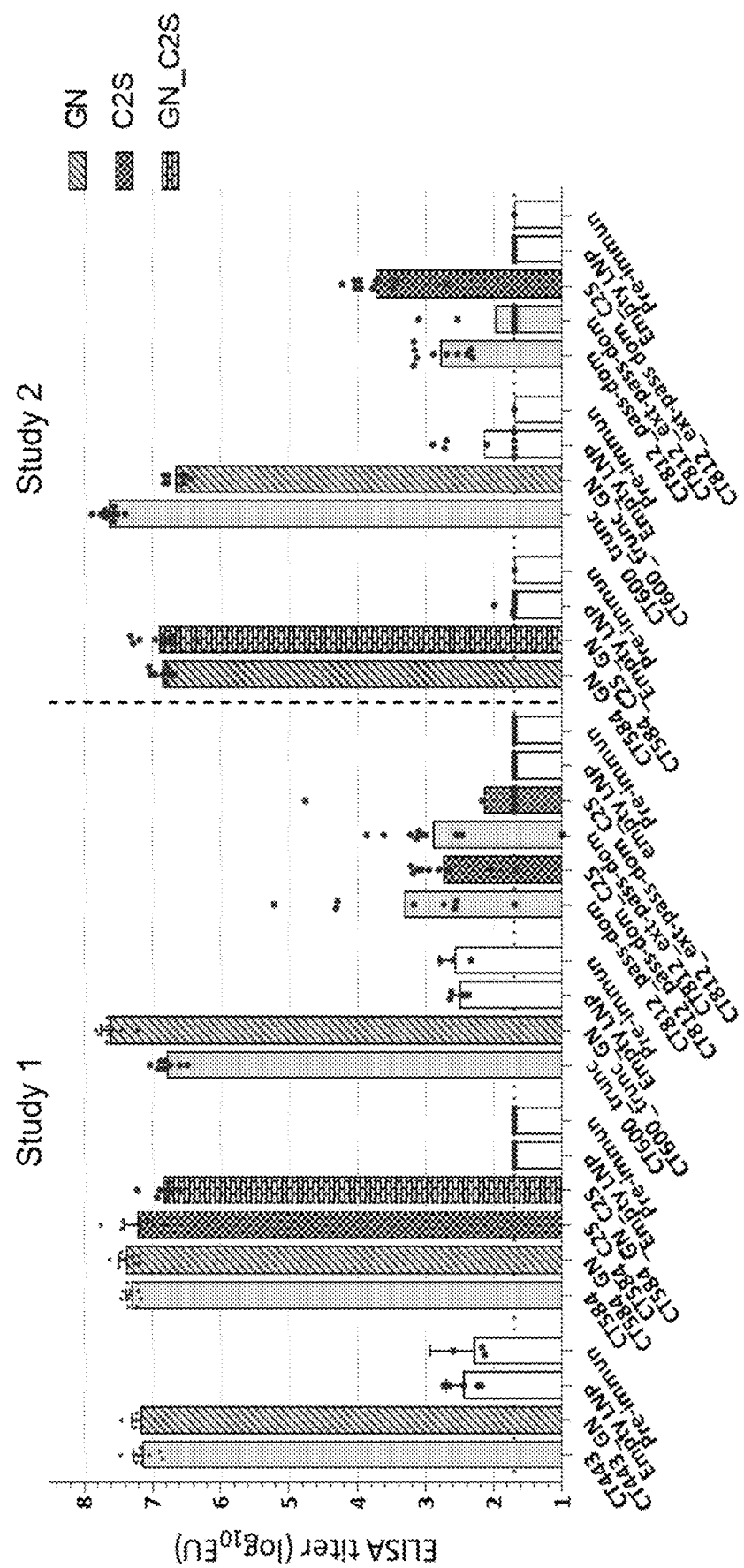
FIG. 19 shows antigen-specific IgG levels, as measured using ELISA, following immunisation with mRNA encoding non-MOMP Ct antigens CT443_ssH1A1 ("CT443"), CT443_ssHA1_GlycNeg ("CT443_GN"), CT584_ssHA1 ("CT584"), CT584_ssHA1 Glycneg ("CT584_GN"), CT584_ssHA1 C2S ("CT584_C2S"), CT584_ssHA1_Glycneg_C2S ("CT584_GN_C2S"), CT600_trunc_ssHA1 ("CT600_trunc"), CT600 trunc_ssHA1_Glycneg ("CT600_trunc_GN"), CT812_pass-domain_ssHA1 ("CT812_pass-dom"), CT812_pass-domain_ssHA1_C2S ("CT812_pass-dom_C2S"), CT812_ext-pass-domain_ssHA1 ("CT812ext-pass-dom"), CT812_ext-pass-domain_ssHA1_C2S ("CT812_ext-pass-dom_C2S").

As shown in FIG. 19, all samples tested gave rise to high titers of IgGs which were specific against their respective protein, with the exception of CT812, which elicited lower IgG titers for all constructs.

mRNA Constructs Encoding Non-MOMP Ct Antigens Induce a T Cell Response

Further mRNA constructs (all modified) encoding non-MOMP Ct antigens (CT443_ssHA1 ("CT443", encoding protein of SEQ ID NO: 105), CT584_ssHA1_GlycNeg ("CT584_GlycNeg", encoding protein of SEQ ID NO:108), CT600_trunc_ssHA1_Glycneg ("CT600_GlycNeg", encoding protein of SEQ ID NO:112) were tested for their ability to induce a T cell response, as compared to a control of mRNA encoding MOMP_serE_FL_ssHA1 ("MOMP ser E FL"; encoding protein of SEQ ID NO: 29).

Mice received two immunisations of mRNA ssHA1-constructs at 0.125 μg dose, formulated with the LNP OF-02, given by IM route, at 0 and 3 weeks (W0 and W3). Study included a negative empty-LNP (OF-02) and a positive MOMP_serE_FL_ssHA1 control. Splenocytes were collected two weeks post-boost and T specific cellular response was assessed by ELISPOT/FluoroSpot and by ICCS.

Ability to Elicit IFNγ-Producing T Cells (FluoroSpot)

First, ability to elicit IFNγ-producing T cells was tested using FluoroSpot. For the FluoroSpot assay, spleen cells ($2\times10^5$ per well) were plated in 200 µl RPMI complete together with and without respective native peptide pools (as described above) in presence of IL2 (Roche) in triplicate cultures each. Subsequently plates were incubated at 37° C., 5% $CO_2$ for 20 h. After washing with PBS, plates were incubated with detection Ab anti-IFNγ (mAb R4-6A2-BAM) for 2 h at RT. Image analysis of FluoroSpot assays was performed on Microvision Reader.

Figure 20:
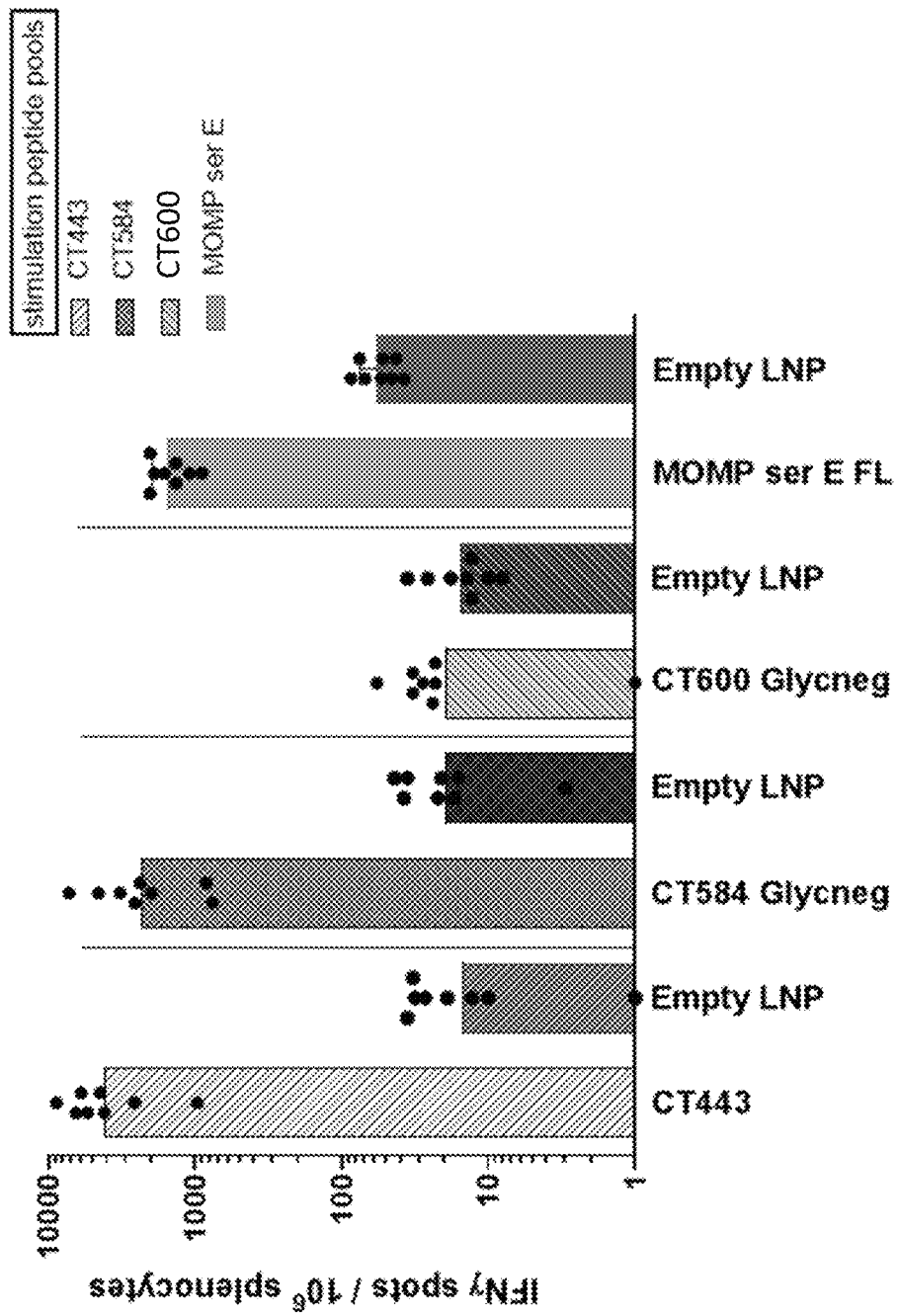
FIG. 20 shows induction of IFNγ-producing T cells in mice following immunisation with mRNA encoding non-MOMP Ct antigens CT443_ssHA1 ("CT443"), CT584_ssHA1_GlycNeg ("CT584_GlycNeg"), or CT600_trunc_ssHA1_Glycneg ("CT600 GlycNeg"), or with mRNA encoding recombinant MOMP serovar E protein as a control.

As shown in FIG. 20, the CT443 and CT584_GlycNeg constructs were able to induce similarly high, if not enhanced, levels of IFNγ-producing T cells, relative to the MOMP_serE_FL construct. However, CT600_GlycNeg did not induce similarly high levels of IFNγ-producing T cells.

Ability to Elicit CD4+ IFNγ+, CD8+ IFNγ+, and Polyfunctional Cell Responses (ICCS)

For ICCS, isolated lymphocytes were activated with specific respective peptide pools (as described above) at $1\times10^6$ cells/well in 96-well plates and cultured for 6 h in 5% $CO_2$ at 37° C. with BFA in order to block cytokine secretion. Activated cells were harvested for surface and intracellular cytokine staining. Surface staining of the cells was performed by incubating with fluorescent conjugated monoclonal antibodies specific to CD3, CD4, and CD8 for 20 min on ice. After surface staining, the cells were washed two times, fixed and permeabilized for 20 min at +4° C. using BD Cytofix/Cytoperm buffer (BD Biosciences) and washed twice with the BD Perm/Wash buffer. Intracellular cytokine staining was then performed by incubating with the fluorescent conjugate antibodies against murine IL-2, IL-5, IL-10, TNF-α, and IFN-γ on ice for 30 min. The cells were washed three times and analyzed with a FACS Fortessa flow cytometer (BD Biosciences).

As shown in FIG. 21A, the CT443 construct gave rise to a CD4+ IFNγ T cell response, albeit at a lower level relative to MOMP_serE_FL_ssHA1 ("MOMP ser E FL"). Immunisation with either of CT584_GlycNeg or CT600_GlycNeg did not appear to give rise to a CD4+ IFNγ T cell response.

As shown in FIG. 21B, the CT443 and CT584_GlycNeg constructs each gave rise to a relatively strong CD8+ IFNγ T cell response. MOMP_serE_FL_ssHA1 ("MOMP ser E FL") and CT600 GlycNeg CD8+ IFNγ T cell responses were indistinguishable from empty LNP control.

Figure 22A:
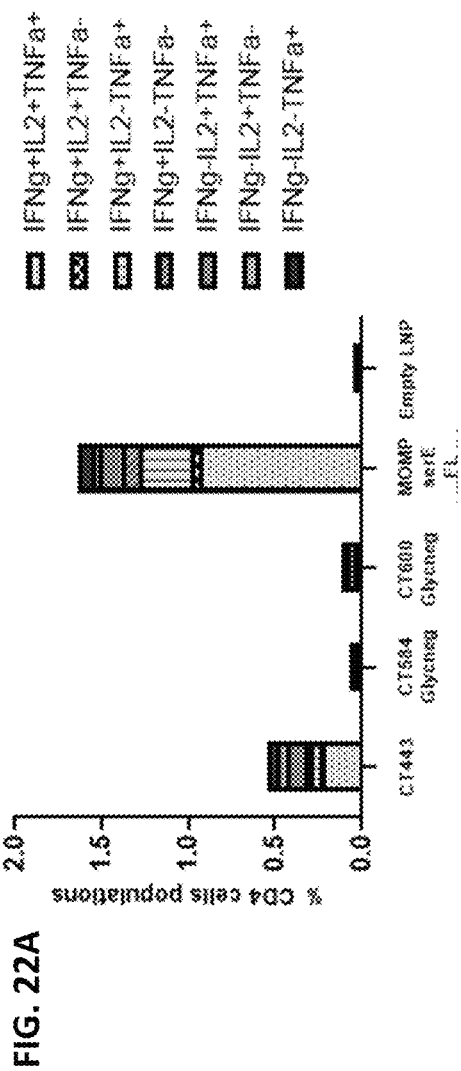
FIGS. 22A-22B show the percentage of (FIG. 22A) CD4+ T cells and (FIG. 22B) CD8+ T cells in mice producing each of IFNγ ("IFNg"), IL2, and/or TNFα ("TNFa") (singularly and in the various combinations thereof), after mice are immunised with mRNA encoding non-MOMP Ct antigens CT443_ssHA1 ("CT443"), CT584_ssHA1_GlycNeg ("CT584_GlycNeg"), or CT600_trunc_ssHA1_Glycneg ("CT600_GlycNeg"), or with mRNA encoding recombinant MOMP serovar E protein as a control.

The mRNA constructs were also assessed for their ability to induce polyfunctional cells. FIG. 22 shows, for each of the mRNA constructs, the percentages of CD4+ (A) and CD8+ (B) antigen-specific T cells that were elicited and indicates the percentage of CD4+ and CD8+ T cells producing each of IFNγ ("IFNg"), IL2, and/or TNFα ("TNFα") (singularly and in the various combinations thereof). CD4+ responses were elicited for each of MOMP_serE_FL_ssHA1 ("MOMP ser E FL") and CT443, and the polyfunctional CD4+ IFNγ+IL2+ TNFα+ cell population formed the majority, relative to the other CD4+ T cell populations (FIG. 22A).

Figure 22B:
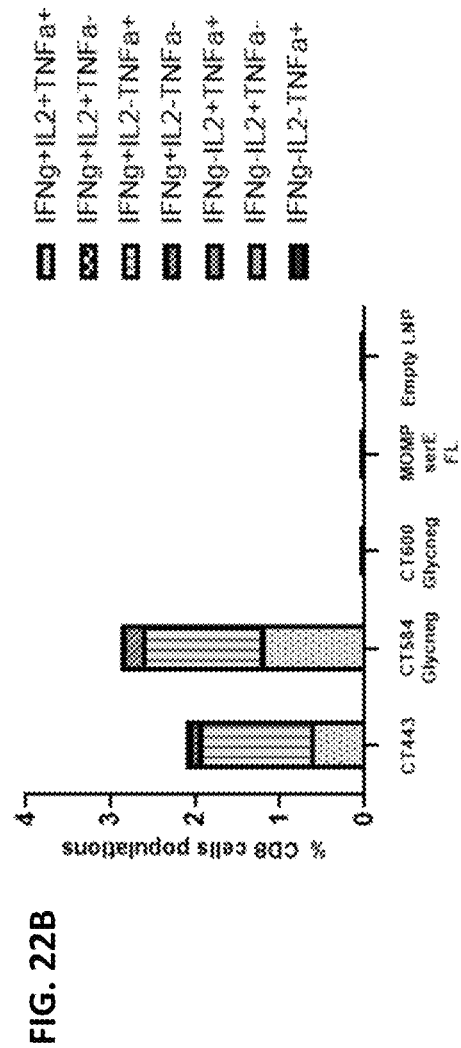

CD8+ responses were elicited for each of CT443 and CT584 GlycNeg, and the CD8+ IFNγ+IL2-TNFα+ cell population formed the majority, relative to the other CD8+ T cell populations (FIG. 22B).

Non-MOMP Ct Antigen Constructs are Able to Induce Specific IgG Against their Encoded Proteins at a Low Dose of 0.125 µg Further non-MOMP Ct antigens were tested for their ability to induce specific IgG against their respective protein. mRNA constructs (all modified) included: CT443_ssHA1 ("CT443", encoding protein of SEQ ID NO: 105, CT584_ssHA1 GlycNeg ("CT584 mRNA", encoding protein of SEQ ID NO: 108), CT600_trunc_ssHA1_Glycneg ("CT600 mRNA", encoding protein of SEQ ID NO:112). Protein constructs included: Recombinant (rProt) CT584 (SEQ ID NO: 145), rProt CT600 (SEQ ID NO: 146) and rProt CT443 (SEQ ID NO: 143).

Mice received two immunisations of mRNA constructs and recombinant protein at 0.125 and 5 µg dose respectively, formulated with the LNP OF-02 and SPA14 respectively, given by IM route, at 0 and 3 weeks (W0 and W3). Studies included a negative empty OF-02 LNP control. Blood samples were collected at 0 weeks (W0) and two weeks after the last vaccine administration, in order to measure total IgG by ELISA. The specific IgG were measured from individual sera using automated 384 ELISA.

Briefly, 384-well micro-plates were coated in carbonate buffer with 20 µL per well of respective protein (CT443 (4 µg/mL), CT584 (1 µg/mL), CT600 (4 g/mL)) and kept overnight at +4° C. Coating solution was removed and washed with buffer 1 (PBS/Tween 0.05%). Free sites were blocked with 75 µL of buffer 2 (PBS/Tween 20 0.05%/milk 1%) and incubated 90 min at room temperature (RT). Plates were emptied, then sera were serially diluted in buffer 2 under a volume of 20 µL (12 times) in the microplates. The plates were incubated for 90 min at RT and then washed with buffer 1. 20 µl of a diluted anti-mouse total IgG peroxidase conjugate (Southern Biotech) was added in each well (¹/₁₀₀₀). After 90 min incubation at RT, the plates were washed with buffer 1. The reaction was developed by adding 20 µL of a tetramethylbenzidine substrate solution in each well. The reaction was chemically stopped after 30 min at RT with HCl (1N (normality)) and absorbance was measured at 450-650 nm on a spectrophotometer (Synergy HTX, Biotek). The results were analyzed in Softmax Pro software using a standard curve and expressed in arbitrary ELISA units by the reciprocal dilution corresponding to an OD of 1.

Figure 23:
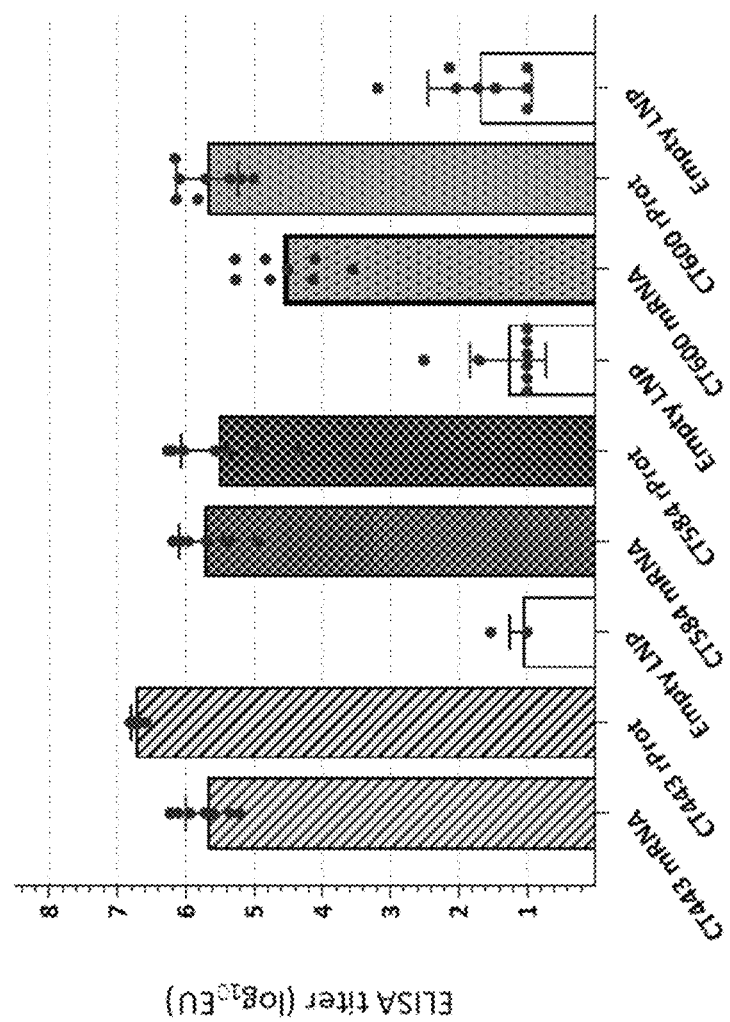
FIG. 23 shows antigen-specific IgG levels, as measured using ELISA, following immunisation of mice with mRNA encoding non-MOMP Ct antigens CT443_ssHA1 ("CT443 mRNA") CT584_ssHA1_GlycNeg ("CT584 mRNA"), CT600_trunc_ssHA1_Glycneg ("CT600 mRNA") or with one of recombinant proteins (rProt) CT584, CT600 and CT443.

As shown in FIG. 23, all samples tested gave rise to high titers of IgGs which were specific against their respective protein, even at the low dose of 0.125 µg.

Non-MOMP Ct Antigen Constructs Elicit Antibodies Binding to Elementary Bodies (EBs)

The following mRNA constructs of non-MOMP Ct antigens (all modified mRNA) were tested for their ability to induce IgGs binding EBs of serovars E, D, or G. Constructs were formulated with the LNP OF-02. 8 or 10 mice (C57BL/6) were used in each study group and 5 mice were used for each negative control.

The following constructs were tested:
CT443_ssHA1 ("CT443", encoding protein of SEQ ID NO:105),
CT443_ssHA1_GlycNeg ("CT443 GN", encoding protein of SEQ ID NO:106),
CT584_ssHA1 ("CT584", encoding protein of SEQ ID NO:107),
CT584_ssHA1_Glycneg ("CT584_GN", encoding protein of SEQ ID NO:108),
CT584_ssHA1 C2S ("CT584_C2S", encoding protein of SEQ ID NO:109),
CT600_trunc_ssHA1 ("CT600_trunc", encoding protein of SEQ ID NO: 111), CT600_trunc_ssHA1_Glycneg ("CT600_trunc_GN", encoding protein of SEQ ID NO:112) in two independent studies, CT812pass-domain_ssHA1 ("CT812pass-dom", encoding protein of SEQ ID NO: 113), CT812_pass-domain_ssHA1_C2S ("CT812_pass-dom_CS2", encoding protein of SEQ ID NO: 114), CT812_ext-pass-domain_ssHA1 ("CT812_ext-pass-dom", encoding protein of SEQ ID NO: 115) in two independent studies, CT812_ext-pass-domain_ssHA1_C2S ("CT812_ext-pass-dom_C2S", encoding protein of SEQ ID NO: 116).

Mice received two immunisations of mRNA constructs at 5 g dose, formulated with the LNP OF-02, given by IM route, at 0 and 3 weeks (W0 and W3) in at least one of two independent studies. Blood samples were collected at 0 weeks (W0) and two weeks after the last vaccine administration, in order to measure total IgG by ELISA. The specific IgG were measured from individual sera using automated 384 ELISA.

Briefly, 384-well micro-plates were coated in carbonate buffer with 20 µL per well of EBs at 5-15 µg/mL depending on the serovar (5 g/mL for EBs of serovar G, 7.5 µg/mL for EBs of serovar D, and 15 µg/mL for EBs of serovar E) and kept overnight at +4° C. Coating solution was removed and washed with buffer 1 (PBS/Tween 0.05%). Free sites were blocked with 75 µL of buffer 2 (PBS/Tween 20 0.05%/milk 1%) and incubated 90 min at room temperature (RT). Plates were emptied, then sera were serially diluted in buffer 2 under a volume of 20 µL (12 times) in the microplates. The plates were incubated for 90 min at RT and then washed with buffer 1. 20 µL of a diluted anti-mouse total IgG peroxidase conjugate (Jackson Inc) was added in each well (1/2500). After 90 min incubation at RT, the plates were washed with buffer 1. The reaction was developed by adding 20 µL of a tetramethylbenzidine substrate solution in each well. The reaction was chemically stopped after 30 min at RT with HCl (1N (normality)) and absorbance was measured at 450-650 nm on a spectrophotometer (Synergy HTX, Biotek). The results were analyzed in Softmax Pro software using a standard curve and expressed in arbitrary ELISA units by the reciprocal dilution corresponding to an OD of 1.

Figure 24:
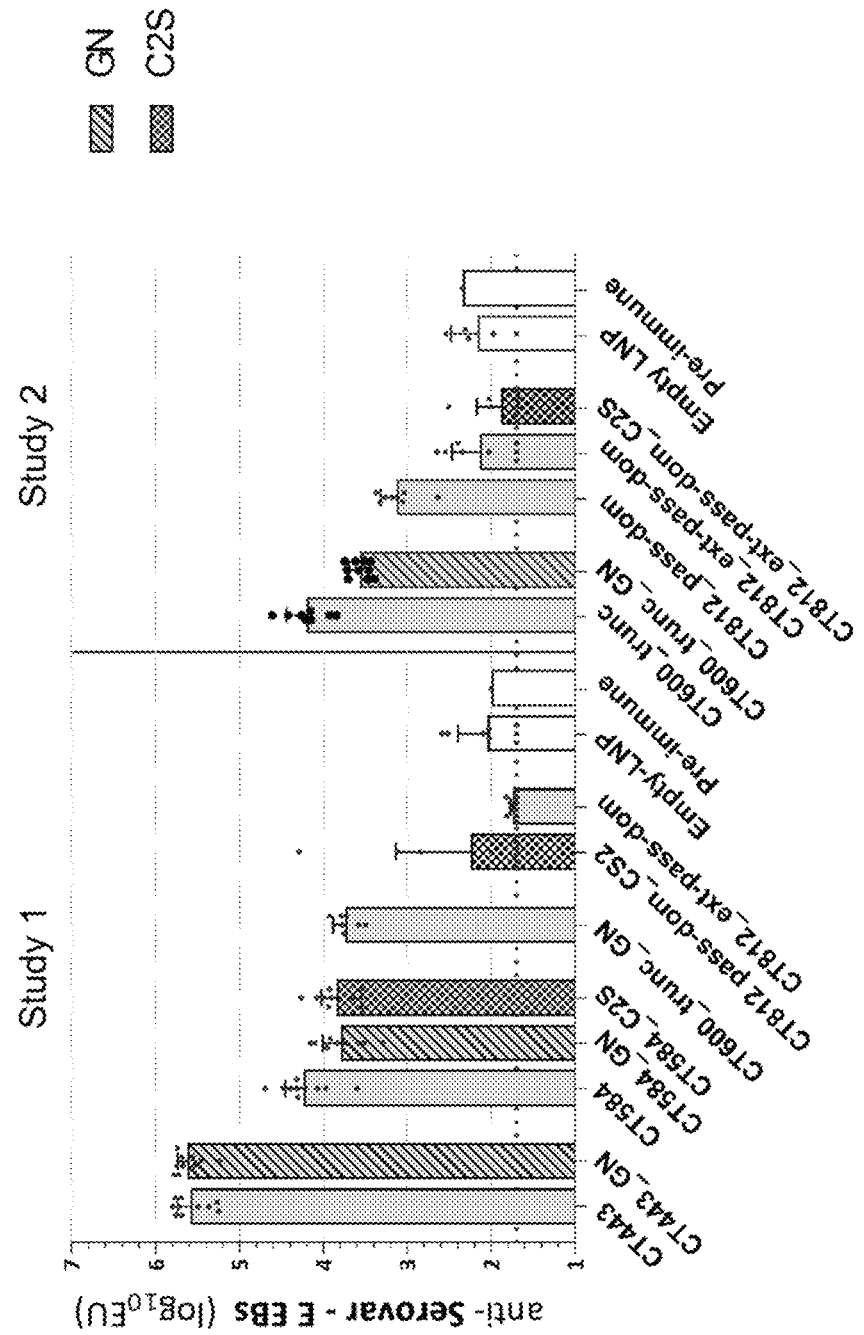
FIG. 24 shows the level of IgG binding to EBs of serovar E, as measured using ELISA, following immunisation of mice with mRNA encoding non-MOMP Ct antigens CT443_ssHA1 ("CT443"), CT443_ssHA1_GlycNeg ("CT443_GN"), CT584_ssHA1 ("CT584"), CT584_ssHA1_GlycNeg ("CT584_GN"), CT584_ssHA1_C2S ("CT584 C2S"), CT600_trunc_ssHA1_Glycneg ("CT600_trunc"), CT600_trunc_ssHA1_Glycneg ("CT600_trunc_GN"), CT812_pass-domain_ssHA1 ("CT812_pass-dom"), CT812pass-domain_ssHA1_C2S ("CT812_pass-dom_CS2"), CT812_ext-pass-domain_ssHA1
Figure 25:
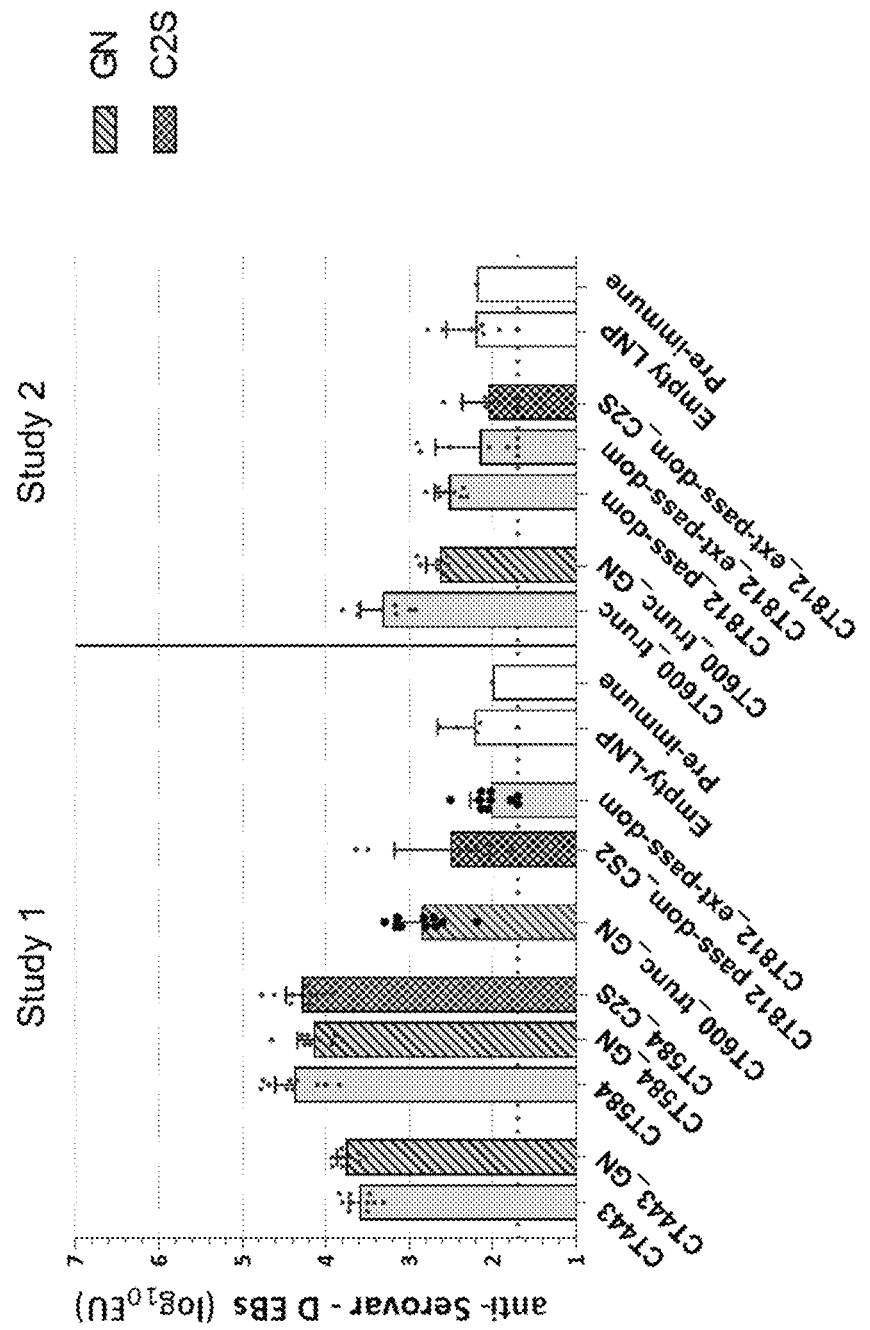
Figure 26:
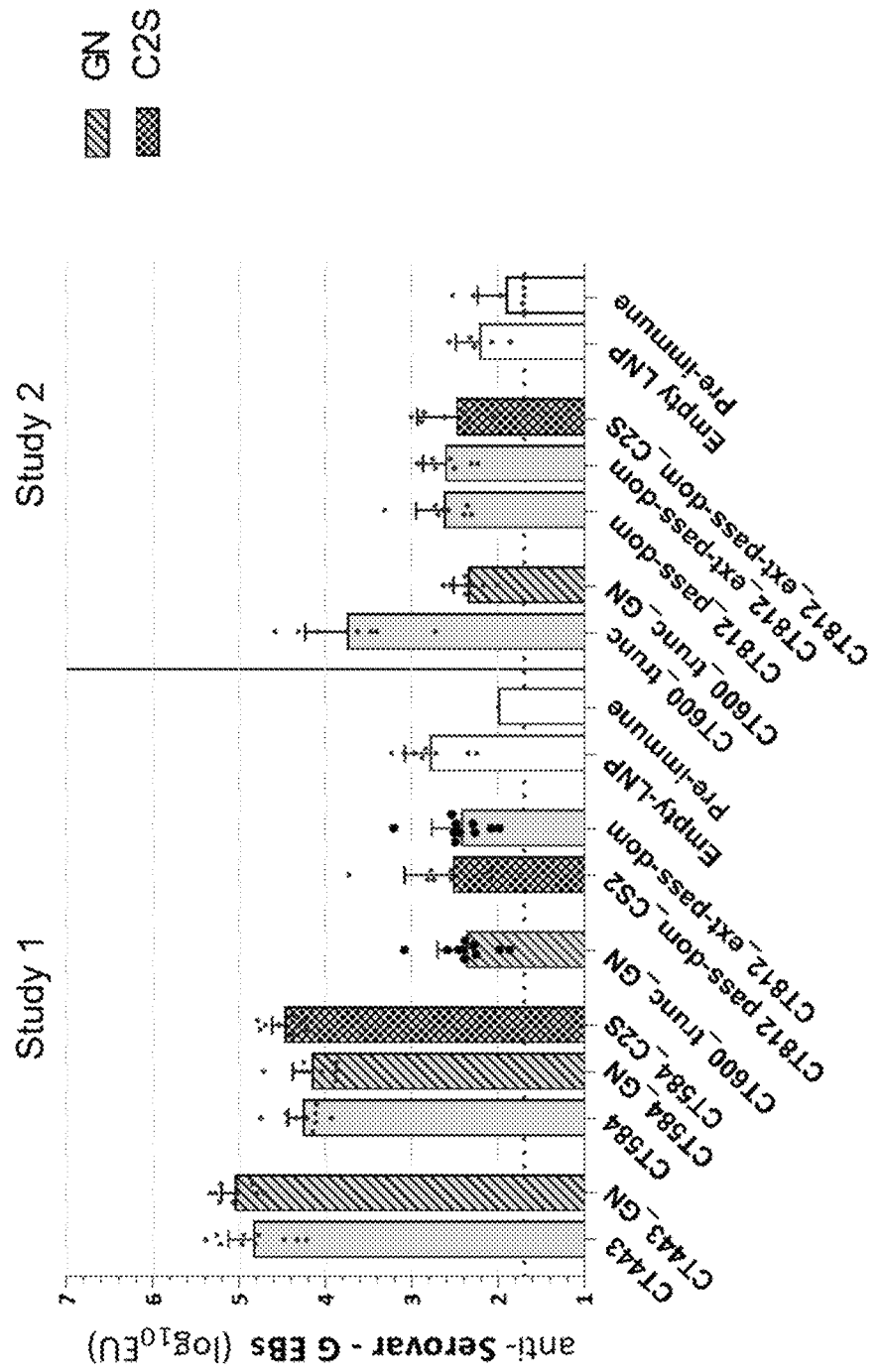

As shown in FIG. 24, various non-MOMP Ct mRNA constructs elicited IgGs which bound to EBs of serovar E. In particular, the CT443, CT584, and CT600 constructs induced acceptable levels of antibodies against EBs of serovar E, which were higher than background levels. Of the CT812 constructs, only the CT812_pass-dom construct induced an acceptable level of antibodies against EBs of serovar E; however, the level remained lower than those observed for the CT443, CT584, and CT600 constructs.

As shown in FIGS. 25 and 26, CT443 and CT584 constructs also induced acceptable levels of antibodies which bound to EBs of serovars D and G.

Example 9—B Cell Constructs are Able to Induce Specific IgG Against MOMP Ser E B cell constructs (all modified mRNA) were tested for their ability to induce specific IgG against recombinant MOMP protein (SEQ ID NO: 134).

The following constructs were tested:

1. Hirep2_ssHA1 (encoding protein of SEQ ID NO: 93)
2. MOMP_VDcomb1-extP_ssHA1 ("MOMP_C1_P_SSHA1", encoding protein of SEQ ID NO: 61)

3. MOMP_VDcomb1-extS_ssHA1 ("MOMP_C1_S_SSHA1", encoding protein of SEQ ID NO: 69)
4. MOMP-VDcomb1-extP_ssHA1_TMB1_Glycneg ("MOMP_C1_P_GN_TMB1_SSHA1"; encoding protein of SEQ ID NO: 67)
5. MOMP_VDcomb1-extS_ssHA1_TMB1_Glycneg ("MOMP_C1_S_GN_TMB1_SSHA1" encoding protein of SEQ ID NO: 75)
6. MOMP_VDcomb2-extP_ssHA2_TMB2_Glycneg ("MOMP_C2_P_GN_TMB2_SSHA2"; SEQ ID NO: 84)
7. MOMP_VDcomb2-extP_ssHA1 Glycneg ("MOMP_C2_P_GN_SSHA1", encoding protein of SEQ ID NO: 79)
8. MOMP_VDcomb2-extP_ssHA2_Glycneg ("MOMP_C2_P_GN_SSHA2", encoding protein of SEQ ID NO: 80)
9. MOMP_VDcomb2-extS_ssHA1_Glycneg ("MOMP_C2_S_GN_SSHA1", encoding protein of SEQ ID NO: 87)
10. MOMP_VDcomb2-extP_ssHA1_TMB1_Glycneg ("MOMP_C2_P_GN_TMB1_SSHA1", encoding protein of SEQ ID NO: 83)
11. MOMP_VDcomb2-extS_ssHA1_TMB1 ("MOMP_C2_S_TMB1_SSHA1", encoding protein of SEQ ID NO: 89)
12. MOMP_serD_FL_ssHA1_C2S Glycneg ("MOMP_serD_FL_C2S_GN_SSHA1", encoding protein of SEQ ID NO: 27)
13. MOMP_serG_FL_ssHA1_Glycneg ("MOMP_serG_FL_GN_SSHA1", encoding protein of SEQ ID NO: 49)
14. MOMP_serE_FL_ssHA1 (encoding protein of SEQ ID NO: 29)
15. MOMP_serE_FL_ssHA1_C2S_Glycneg ("MOMP_serE_FL_C2S_GN_SSHA1", encoding protein of SEQ ID NO: 35)
16. recombinant MOMP protein (rMOMP; SEQ ID NO: 134)
17. empty LNP Mice received two immunisations of mRNA constructs at 5 μg dose, formulated with the LNP OF-02, given by IM route, at 0 and 3 weeks (W0 and W3). Studies included a negative empty-LNP control. Blood samples were collected at 0 weeks (W0) and two weeks after the last vaccine administration, in order to measure total IgG by ELISA. The specific IgG were measured from individual sera using automated 384 ELISA.

Briefly, 384-well micro-plates were coated in carbonate buffer with 20 μL per well of recombinant MOMP protein (rMOMP; SEQ ID NO: 134) at 2 μg/mL and kept overnight at +4° C. Coating solution was removed and washed with buffer 1 (PBS/Tween 0.05%). Free sites were blocked with 75 μL of buffer 2 (PBS/Tween 20 0.05%/milk 1%) and incubated 90 min at room temperature (RT). Plates were emptied, then sera were serially diluted in buffer 2 under a volume of 20 μL (12 times) in the microplates. The plates were incubated for 90 min at RT and then washed with buffer 1. 20 μL of a diluted anti-mouse total IgG peroxidase conjugate (Southern Biotech) was added in each well (1/1000). After 90 min incubation at RT, the plates were washed with buffer 1. The reaction was developed by adding 20 μL of a tetramethylbenzidine substrate solution in each well. The reaction was chemically stopped after 30 min at RT with HCl (IN (normality)) and absorbance was measured at 450-650 nm on a spectrophotometer (Synergy HTX, Biotek). The results were analyzed in Softmax Pro software using a standard curve and expressed in arbitrary ELISA units by the reciprocal dilution corresponding to an OD of 1.

Figure 27:
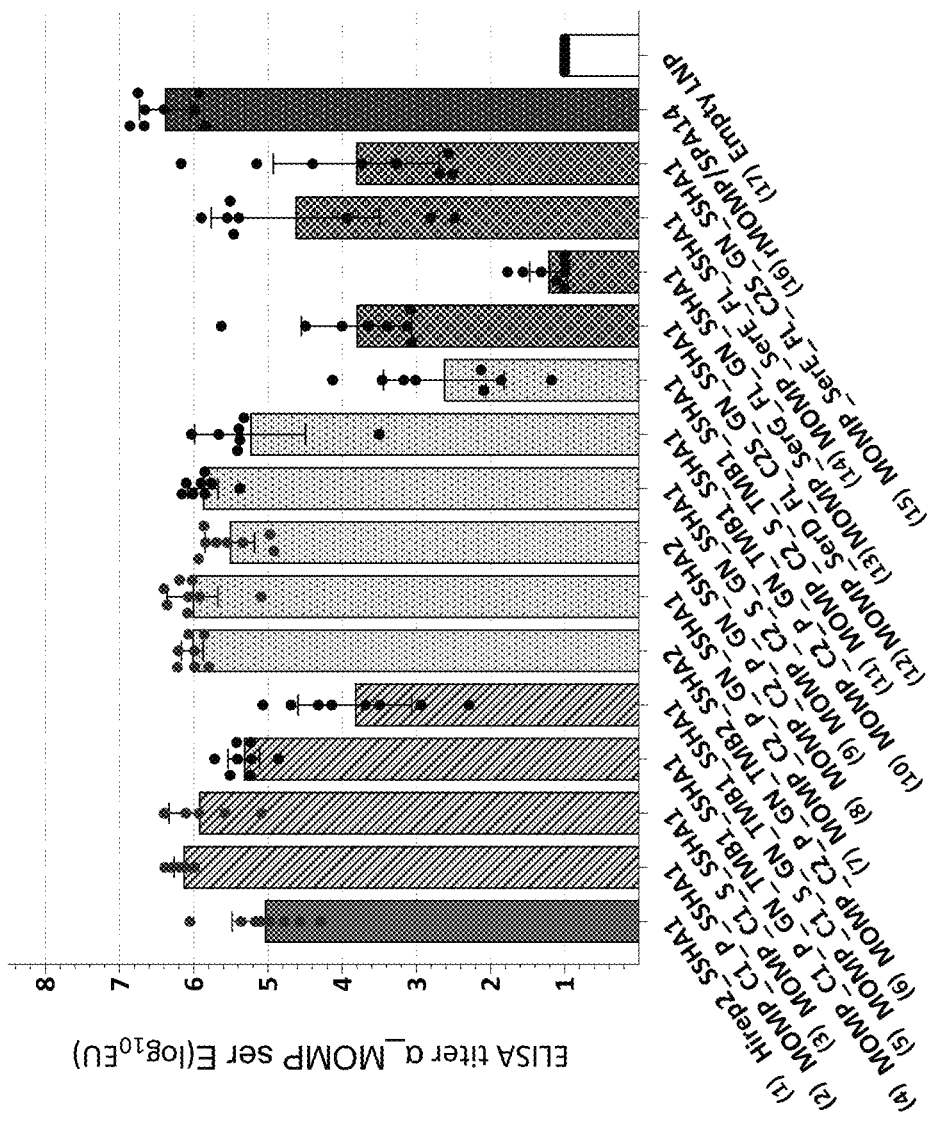

As shown in FIG. 27, all samples tested gave rise to high titers of IgGs which were specific against recombinant MOMP, with exception of the MOMP_SerG_FL_ssHA1 construct, which did not give rise to an anti-MOMP IgG response.

Example 10—B Cell Constructs Elicit Antibodies Binding to Elementary Bodies (EBs)

B cell constructs (all modified mRNA) were tested for their ability to induce IgGs binding to EBs of serovars E, D, or G. Constructs were formulated with the LNP OF-02, while the recombinant MOMP protein (positive control) was formulated with a liposome-based adjuvant containing TLR4 agonist (SPA14, as described in WO2022090359).

The following constructs were tested:
1. MOMP_VDcomb1-extP_ssHA1 ("P" of Chimera 1, encoding protein of SEQ ID NO: 61)
2. MOMP VDcomb1-extS_ssHA1 ("S" of Chimera 1, encoding protein of SEQ ID NO: 69)
3. MOMP-VDcomb1-extP_ssHA1_Glycneg ("P_GN" of Chimera 1; encoding protein of SEQ ID NO: 63)
4. MOMP_VDcomb1-extS_ssHA1_Glycneg ("S_GN" of Chimera 1; encoding protein of SEQ ID NO: 71)
5. MOMP_VDcomb1-extP_ssHA1_TMB1_Glycneg ("P_GN_TMB1" of Chimera 1; encoding protein of SEQ ID NO: 67)
6. MOMP_VDcomb1-extS_ssHA1_TMB1_Glycneg ("S_GN_TMB1" of Chimera 1; encoding protein of SEQ ID NO: 75)
7. MOMP_VDcomb2-extP_ssHA1_Glycneg ("P_GN" of Chimera 2, encoding protein of SEQ ID NO: 79)
8. MOMP_VDcomb2-extS_ssHA1 Glycneg ("S_GN" of Chimera 2, encoding protein of SEQ ID NO: 87)
9. MOMP_VDcomb2-extP_ssHA1_TMB1 Glycneg ("P_GN_TMB1" of Chimera 2, encoding protein of SEQ ID NO: 83)
10. MOMP_VDcomb2-extS_ssHA1_TMB1 ("S_TMB1" of Chimera 2, encoding protein of SEQ ID NO: 89)
11. MOMP_serD_FL_ssHA1 ("Ser D", encoding protein of SEQ ID NO: 21)
12. MOMP_serE_FL_ssHA1 ("Ser_E", encoding protein of SEQ ID NO: 29)
13. MOMP_serF_FL_ssHA1 ("Ser_F", encoding protein of SEQ ID NO: 37)
14. MOMP_serG_FL_ssHA1 ("Ser G", encoding protein of SEQ ID NO: 45)

Mice (C57BL/6) received two immunisations of mRNA constructs at 5 µg dose, formulated with the LNP OF-02, given by IM route, at 0 and 3 weeks (W0 and W3) in at least one of two independent studies. Studies included a negative empty-LNP control and a positive full-length recombinant MOMP protein control (rMOMP; SEQ ID NO: 134, indicated as 'rec Ser E' in FIGS. 28-30). Blood samples were collected at 0 weeks (W0) and two weeks after the last vaccine administration, in order to measure total IgG by ELISA. The specific IgG were measured from individual sera using automated 384 ELISA.

Briefly, 384-well micro-plates were coated in carbonate buffer with 20 µL per well of EBs at 5-15 µg/mL per serovar (5 µg for EBs of serovar G, 7,5 µg for EBs of serovar D, and 15 µg for EBs of serovar E) and kept overnight at +4° C. Coating solution was removed and washed with buffer I (PBS/Tween 0.05%). Free sites were blocked with 75 µL of buffer 2 (PBS/Tween 20 0.05%/milk 1%) and incubated 90 min at room temperature (RT). Plates were emptied, then sera were serially diluted in buffer 2 under a volume of 20 µL (12 times) in the microplates. The plates were incubated for 90 min at RT and then washed with buffer 1. 20 µL of a diluted anti-mouse total IgG peroxidase conjugate (Jackson Inc) was added in each well (1/2500). After 90 min incubation at RT, the plates were washed with buffer 1. The reaction was developed by adding 20 µL of a tetramethylbenzidine substrate solution in each well. The reaction was chemically stopped after 30 min at RT with HCl (1N (normality)) and absorbance was measured at 450-650 nm on a spectrophotometer (Synergy HTX, Biotek). The results were analyzed in Softmax Pro software using a standard curve and expressed in arbitrary ELISA units by the reciprocal dilution corresponding to an OD of 1.

Figure 28:
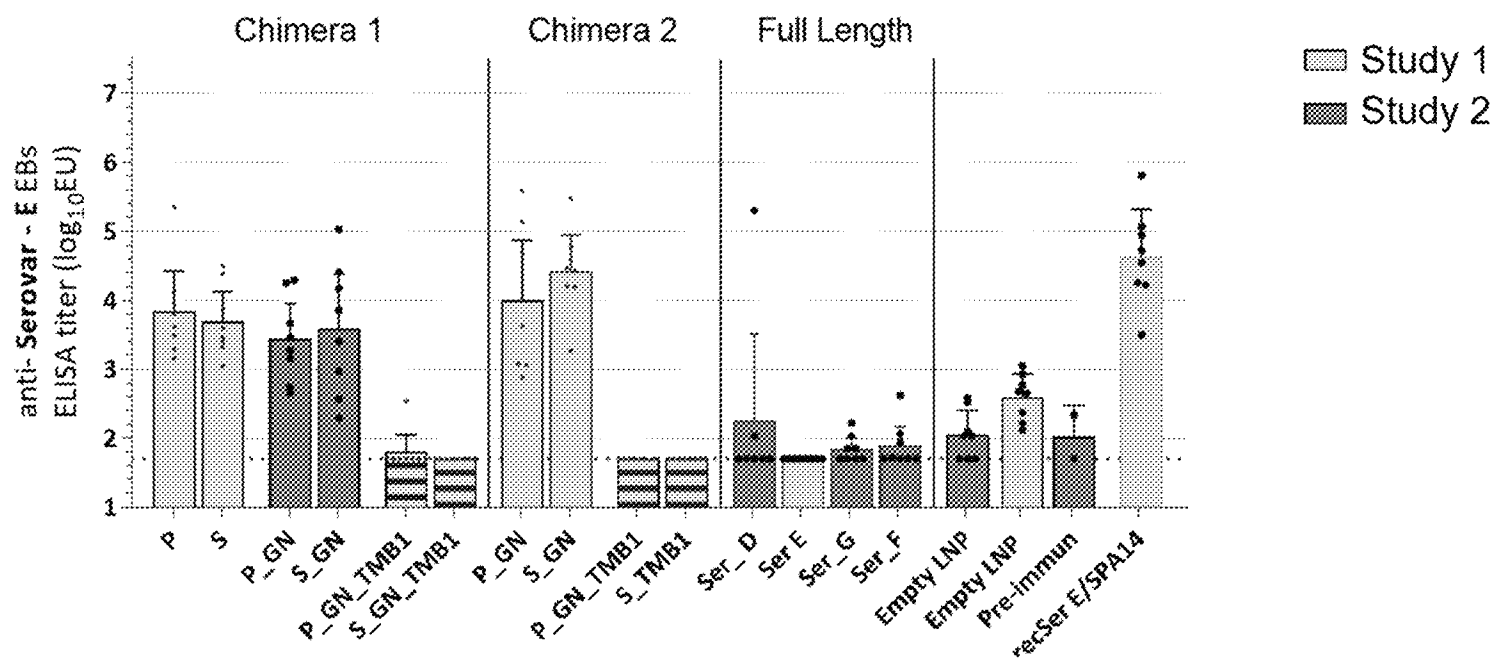

As shown in FIG. 28, various MOMP B cell constructs elicited high titers of IgGs which bound to EBs of serovar E at levels similar to the recombinant MOMP. mRNA constructs comprising a transmembrane domain, as well as mRNA coding full-length MOMP, did not give rise to an anti-EB IgG response, as titers were similar to that of the empty LNP control.

Figure 29:
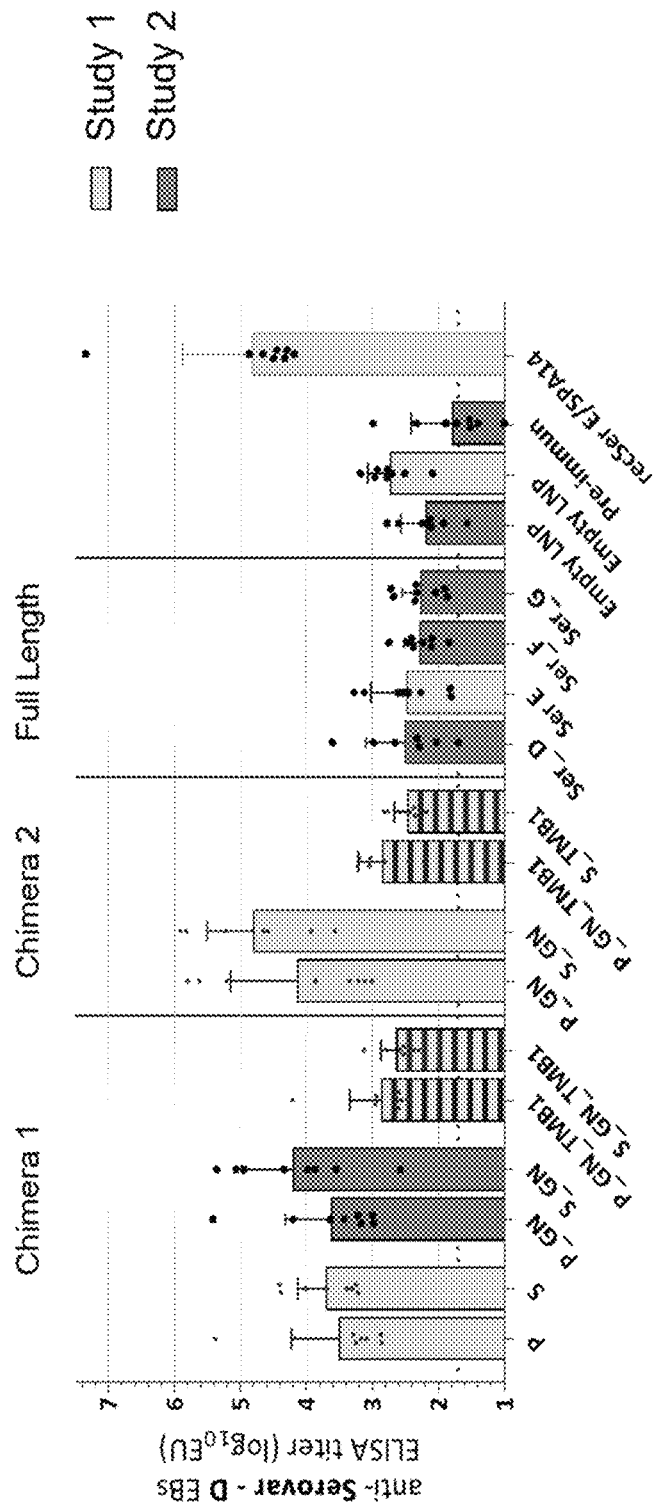
Figure 30:
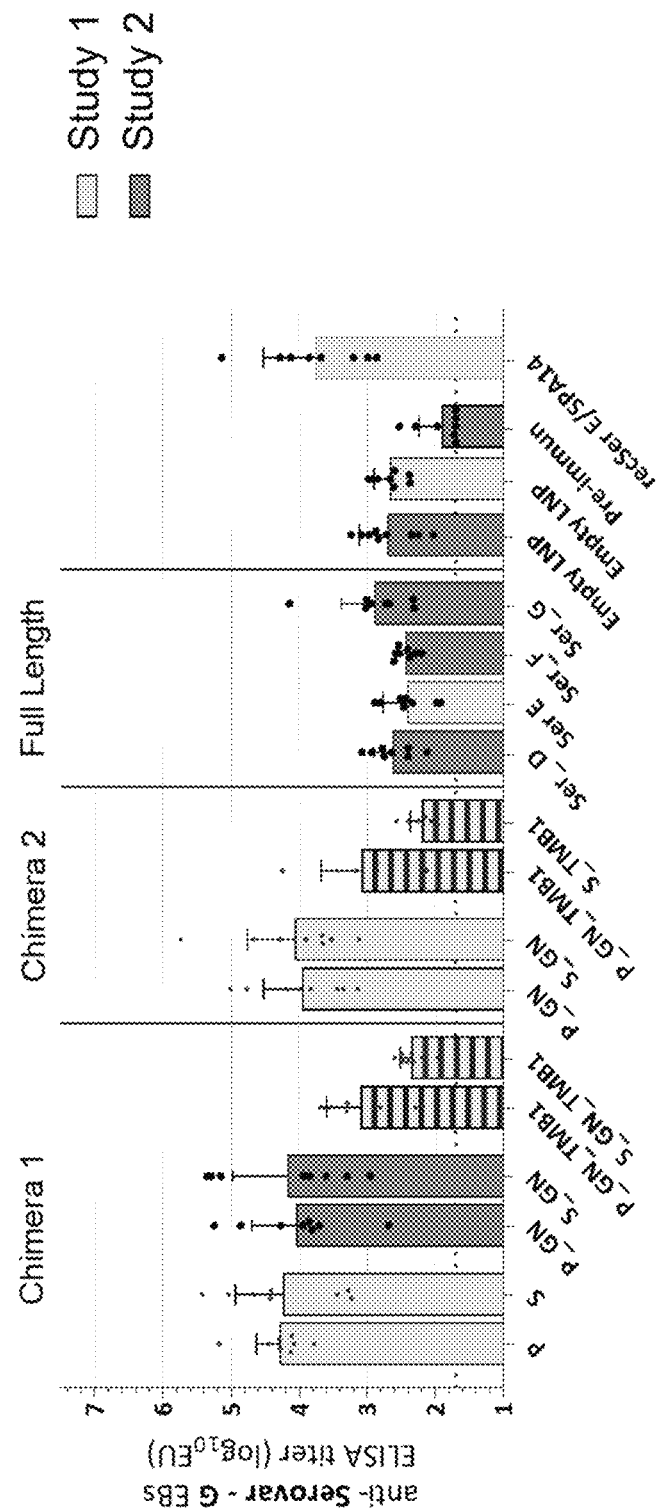

As shown in FIGS. 29 and 30, similar results were observed with binding to EBs of serovar D and serovar G.

Example 11—Immunisation with MOMP mRNA Elicits a Similar Immune Response with Different LNP Formulations Mice (female C57BL/6) were immunised with mRNA (all modified) encoding recombinant MOMP protein formulated in either of two LNPs. The following groups were evaluated:
MOMP P3 ssHA1 ("P3", encoding protein of SEQ ID NO: 53) at a 2 µg dose, formulated in LNP GL-HEPES-E3-E12-DS-4-E10 ("Lipid D") or LNP OF-02 ("Lipid A"),
MOMP_VDcomb2-extS_ssHA1_Glycneg, ("C2-S-GN", encoding protein of SEQ ID NO: 87) at a 2 µg or 5 µg dose, formulated in LNP GL-HEPES-E3-E12-DS-4-E10 ("Lipid D") or LNP OF-02 ("Lipid A").

Mice received two immunisations of mRNA constructs by IM route, at 0 and 3 weeks (W0 and W3). W3 is alternatively referred to as day 21 herein. The study included empty LNP controls. Blood samples were collected at 0 weeks (W0) and final blood samples and spleens were collected one or two weeks after the last vaccine administration. The cellular response was evaluated in samples collected one week post vaccination with a 2 µg dose and the humoral response was evaluated in samples collected two weeks post vaccination with a 5 µg dose. The T specific cellular response was assessed by Intra cellular cell staining (ICCS), as described in Example 7. Induction of specific IgG against recombinant MOMP protein and IgGs binding to EBs of serovars E was assessed as described in Example 8.

Figure 31A:
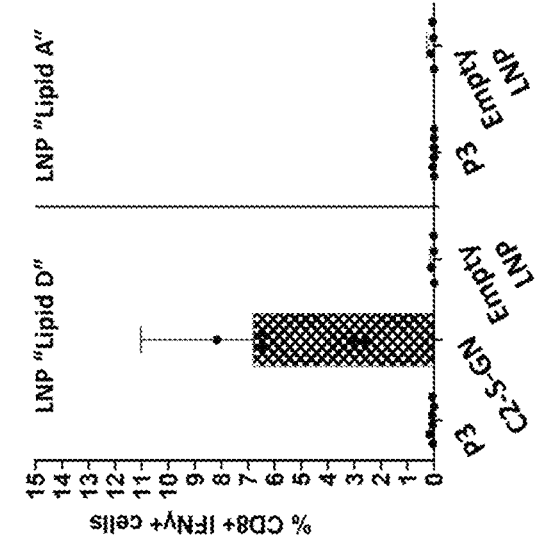
Figure 31B:
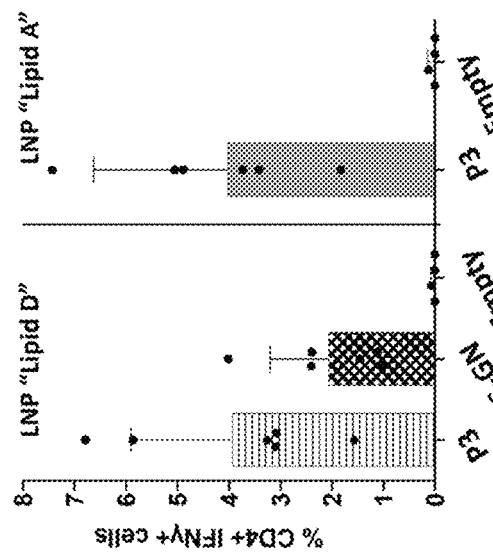

MOMP T Cell Construct Elicits a Strong T Cell Response when Formulated in Different LNPs Immunisation with MOMP_P3_ssHA1 ("P3) gave rise to a significant CD4+ IFNγ T cell response, but very low to no CD8+ IFNγ T cell response was observed, as shown in FIGS. 31A and 31B, respectively. The level of the response was similar between the two formulations evaluated with P3. In contrast, immunisation with the B cell construct ("C2-S-GN") gave rise to both a CD4+ IFNγ T cell response and a CD8+ IFNγ T cell response.

Figure 31C:
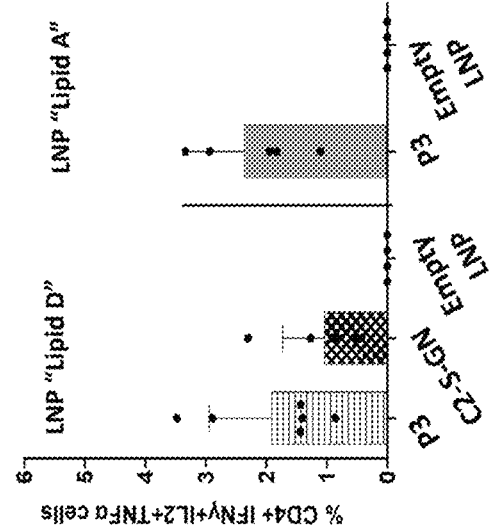

Constructs were also assessed for their ability to induce polyfunctional cells. FIG. 31C shows that the CD4+ IFNγ+

IL2+ TNFα+ cell population was induced by P3 in both formulations, at similar levels, as well as by the B cell construct.

Figure 32A:
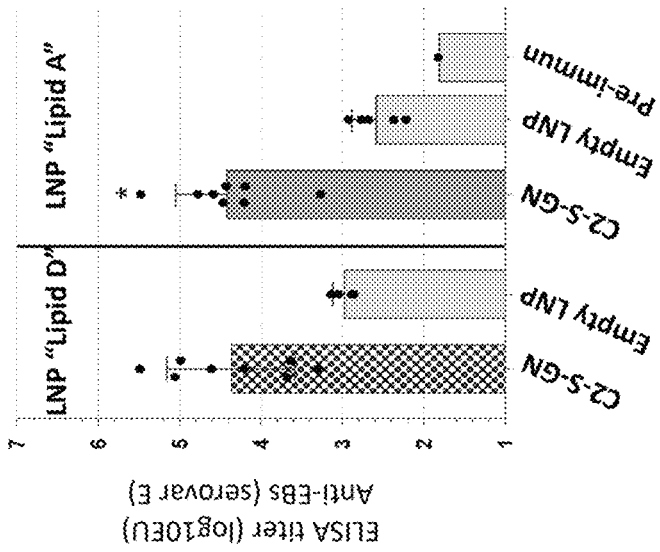
Figure 32B:
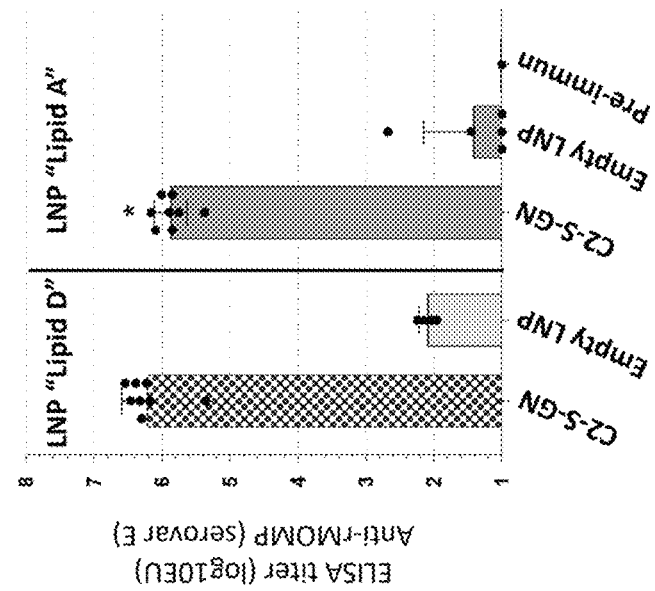

MOMP B Cell Construct Induces Specific IgG Against rMOMP and Against EBs of Serovar E when Formulated in Different LNPs The MOMP B cell construct ("C2-S-GN") gave rise to high titers of IgGs which were specific against recombinant MOMP of serovar E (FIG. 32A) and EBs of serovar E (FIG. 32B) when formulated in different LNPs. Similar levels of IgG were observed between the two formulations.

Example 12—Immunisation with a Multivalent mRNA Composition Elicits an Immune Response Mice (female C57BL/6) were immunised with a multivalent composition composed of four mRNAs (all modified) encoding the following recombinant proteins:
MOMP P3 ssHA1, ("P3", encoding protein of SEQ ID NO: 53),
MOMP_VDcomb2-extS_ssHA1_Glycneg, ("C2-S-GN", encoding protein of SEQ ID NO: 87),
CT443_ssHA1 ("CT443", encoding protein of SEQ ID NO: 105), and
CT584_ssHA1_GlycNeg ("CT584", encoding protein of SEQ ID NO: 108).

The ratio of the mRNAs was 1:1:1:1. Three doses were evaluated. Specifically, doses of 0.4 µg, 1.2 µg and 3.6 µg of each mRNA were evaluated, corresponding to a total mRNA dose of 1.6 µg, 4.8 µg, and 14.4 jig, respectively for each immunisation. The mRNA composition was formulated in LNP GL-HEPES-E3-E12-DS-4-E10 ("Lipid D") or LNP IM-001 ("Lipid G"). The study included empty LNPs equivalent to the amount present for the two highest mRNA doses, as controls. The immunisation and sampling protocols were as described in Example 11. The T specific cellular response was assessed by Intra cellular cell staining (ICCS), as described in Example 7. Evaluation of the induction of specific IgG against recombinant MOMP protein and IgGs binding to EBs of serovars E was performed as described in Example 8. Little to no reactogenicity was observed at these doses.

Figure 33B:
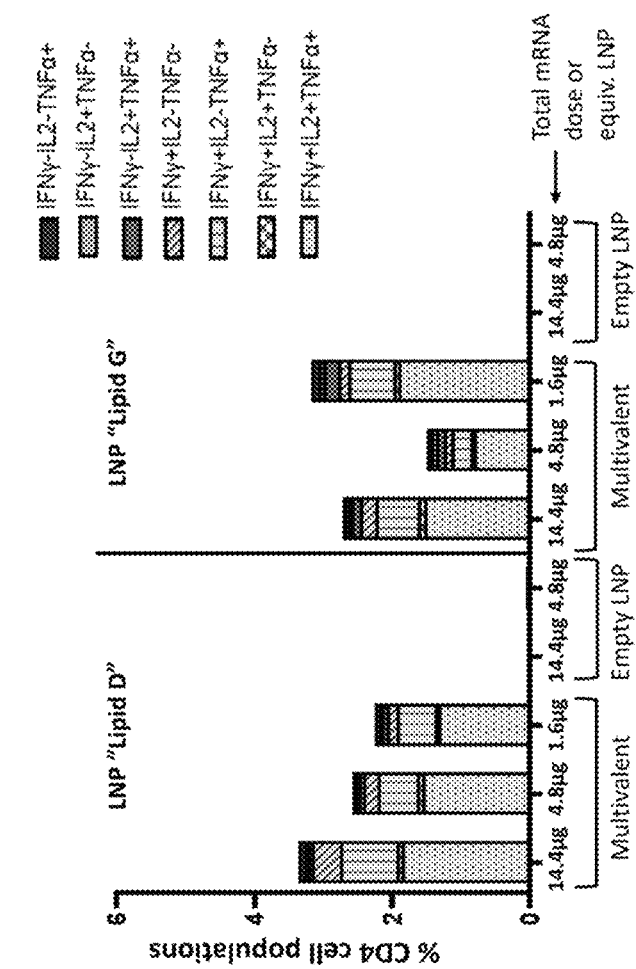
Figure 33A:
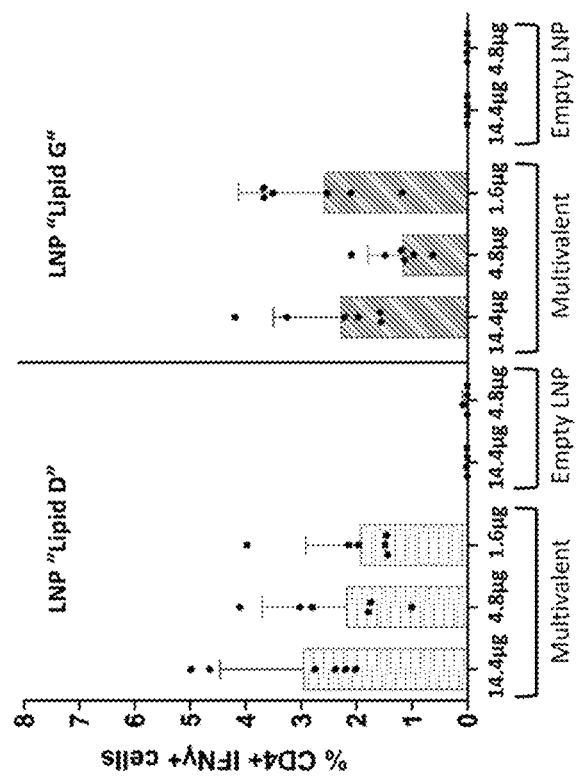

Multivalent Composition Elicits CD4+ IFNγ+, CD8+ IFNγ+, and Polyfunctional Cell Responses (ICCS) when Formulated in Different LNPs The multivalent composition was tested for its ability to elicit MOMP-specific CD4+ IFNγ+ cells, CD8+ IFNγ+ T cells, and polyfunctional cells in mice. As shown in FIG. 33A, the composition gave rise to a significant CD4+ IFNγ T cell response that was distinguishable from the empty LNP control. For the multivalent composition, the CD4+ IFNγ+ IL2+ TNFα+ cell population formed the majority, relative to the other cell populations (see FIG. 33B). Little to no IL-17 or IL-10 was observed for any of the tested constructs (data not shown).

Figures 34A, 34B:
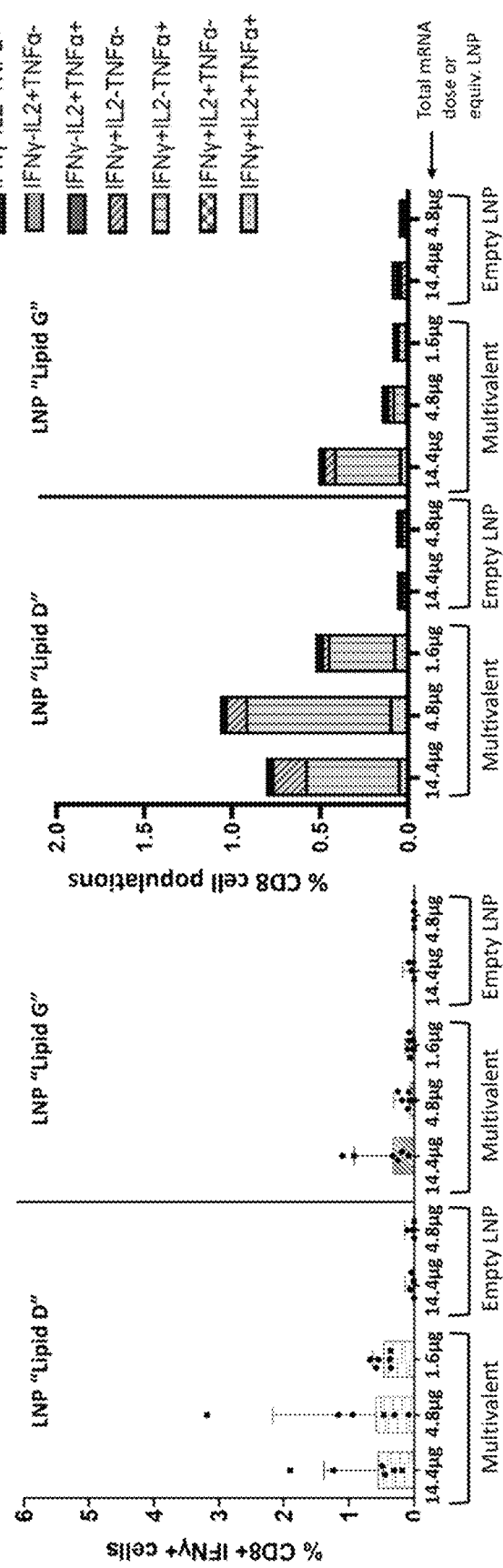

The multivalent composition elicited low levels CD8+ IFNγ (see FIG. 34A), with the CD8+ IFNγ+IL2-TNFα+ cell population forming the majority, relative to the other cell populations (see FIG. 34B). No difference in the response could be observed between the various doses of mRNA formulated in "Lipid D". A difference between the highest dose and the two lower doses was observed for the mRNA formulated in "Lipid G".

Figures 35A, 35B:
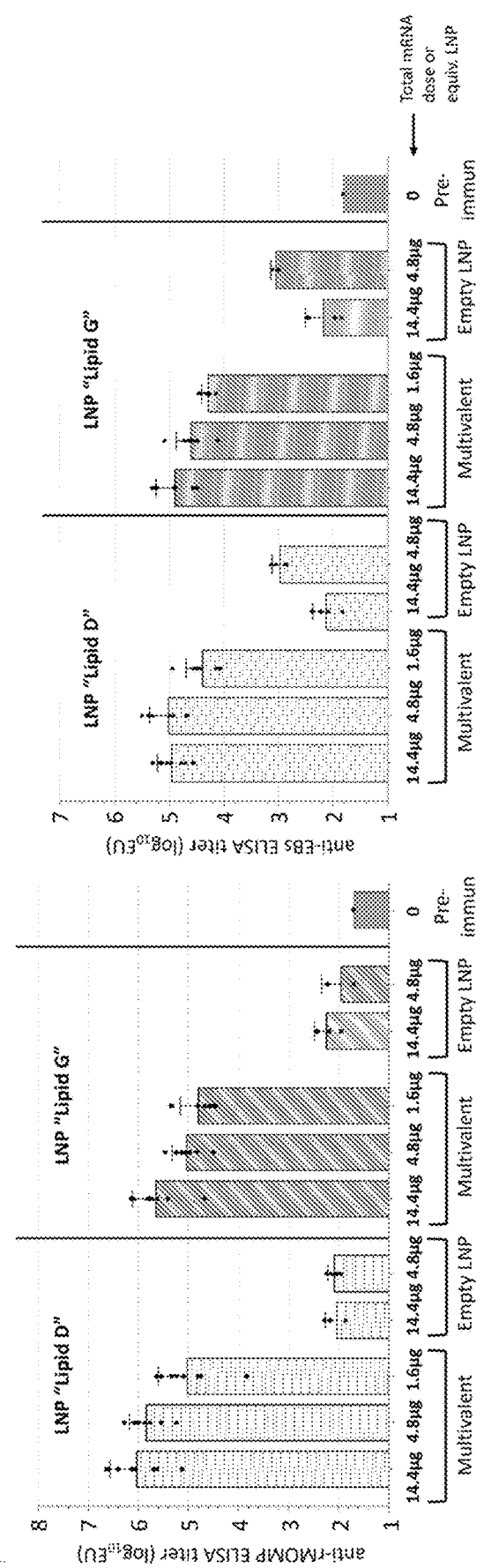

Multivalent Composition Induces Specific IgG Against rMOMP and Against EBs of Serovar E when Formulated in Different LNPs As shown in FIG. 35A, the multivalent composition gave rise to high titers of IgGs which were specific against recombinant MOMP of serovar E at all doses and with both formulations. A dose effect was observed.

The multivalent composition also gave rise to high titers of specific IgGs which bound to EBs of serovar E at all doses and with both formulations, as shown in FIG. 35B.

Figures 36A, 36B:
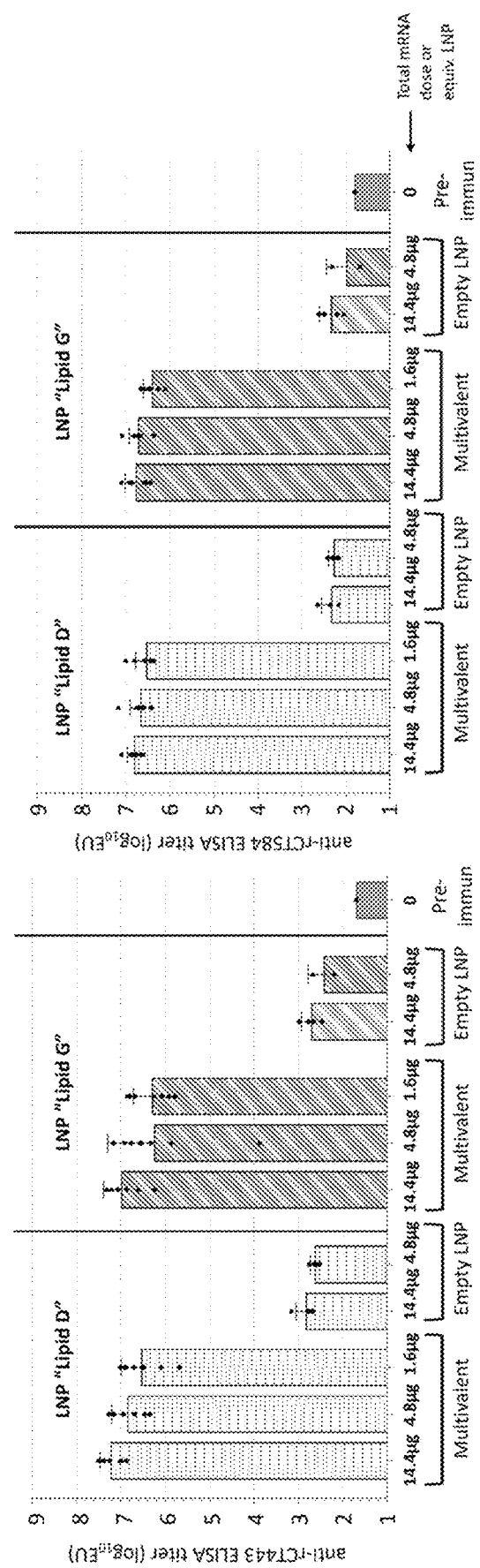

Non-MOMP Ct Antigen Constructs Present in the Multivalent Composition are Able to Induce Specific IgG Against their Encoded Proteins CT443 and CT584 constructs present in the multivalent composition induce high levels of specific IgG against recombinant CT443 and CT584, respectively, as shown in panels A (CT443) and B (CT584) of FIG. 36. Results were similar between the two formulations tested. Results suggest that interference among antigens did not occur, as high levels of specific IgG were induced against each recombinant protein.

Example 13—Immunisation with a Multivalent mRNA Composition Elicits Antibody Binding to Elementary Bodies (EBs) of Serovar E and Serovar G and Respective Recombinant Proteins Mice (female C57BL/6) were immunised with monovalent or multivalent mRNAs (all modified) encoding the following recombinant proteins:
MOMP P3 ssHA1, ("P3", encoding protein of SEQ ID NO: 53),
MOMP_VDcomb2-extS_ssHA1 Glycneg, ("C2-S-GN", encoding protein of SEQ ID NO: 87),
CT443_ssHA1 ("CT443", encoding protein of SEQ ID NO: 105), and
CT584_ssHA1 GlycNeg ("CT584", encoding protein of SEQ ID NO: 108),
a multivalent composition including the mRNAs encoding MOMP P3, MOMP C2-S-GN, CT443 and CT584-GN described above.

Mice received two immunisations of mRNA constructs at 1.2 µg dose, formulated in LNP GL-HEPES-E3-E12-DS-4-E10 ("Lipid D") or LNP IM-001 ("Lipid G"), given by IM route, at 0 and 3 weeks (W0 and W3). The multivalent was formulated with a ratio of 1:1:1:1 of each mRNA construct and injected at 1.2 µg dose of each mRNA construct, 4.8 µg of total mRNA. PBS buffer was administered as a control. Blood samples were collected at 0 weeks (W0) and one week after the last vaccine administration to determine seroconversion, which can be detected at this time point. Seroconversion was determined by measuring total IgG from individual sera using automated 384 ELISA as described above in Example 8 for non-MOMP antigen constructs and Example 9 for MOMP antigen constructs. IgG titers were analyzed using one-way ANOVA with group as fixed factor. A Dunnett adjustment was performed.

Figure 37A:
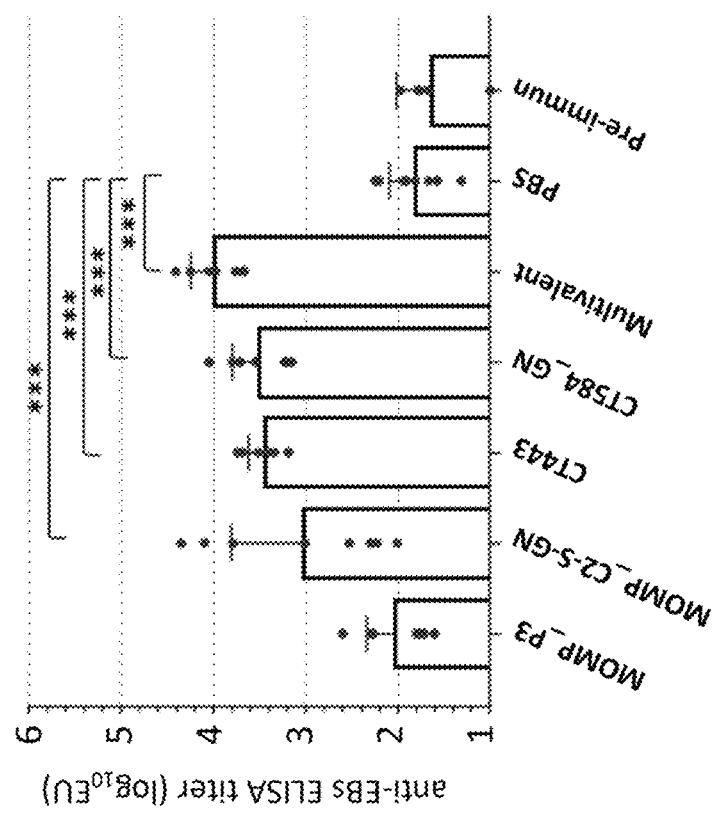
Figure 37B:
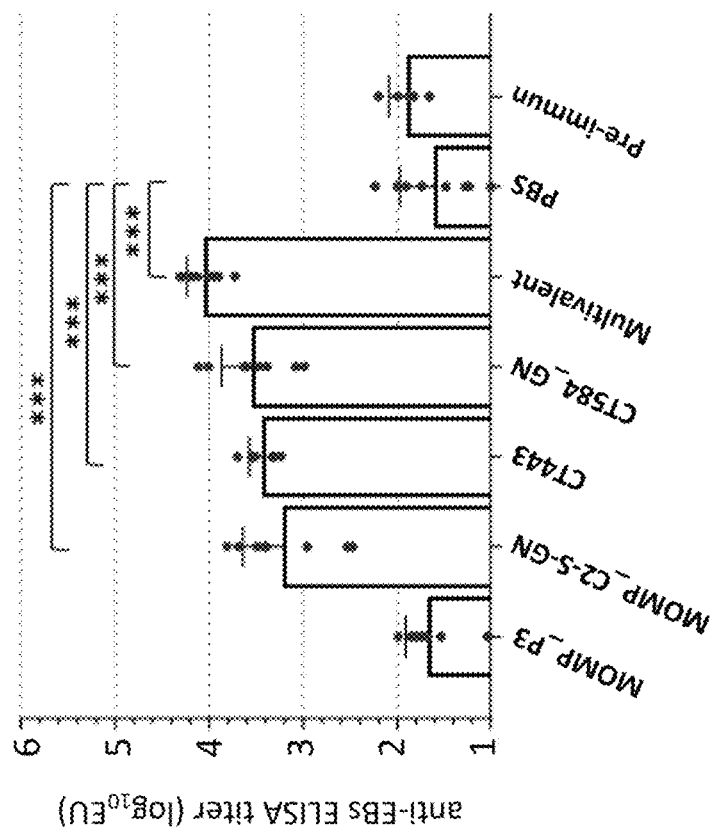
Figure 38A:
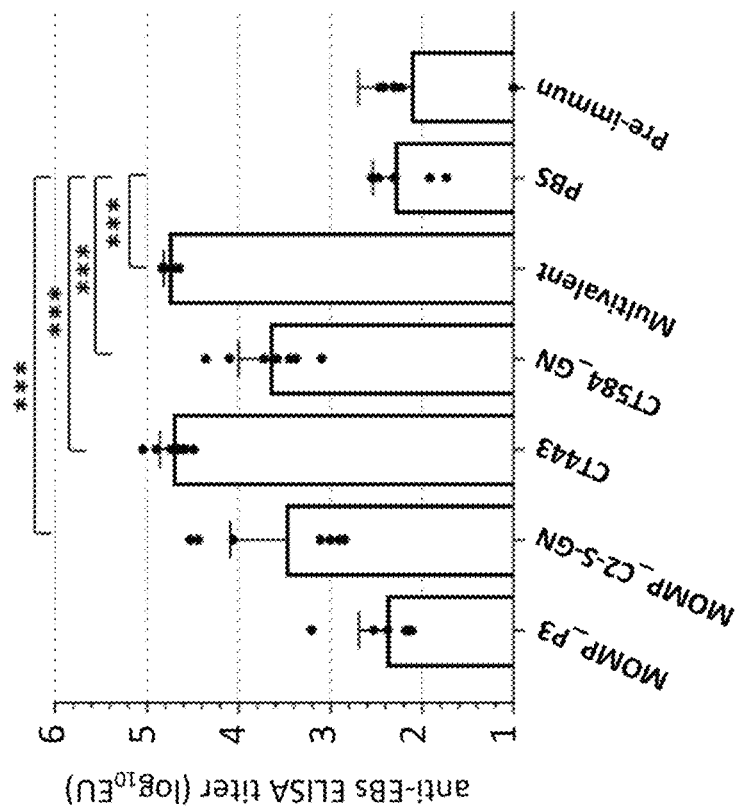
Figure 38B:
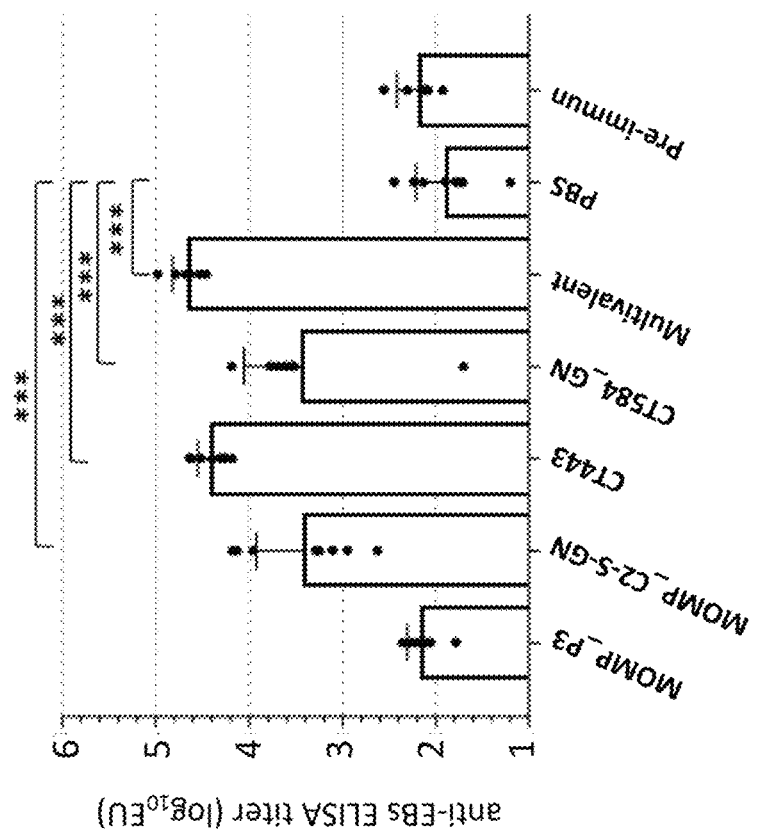

As shown in FIGS. 37 and 38, all monovalent and multivalent constructs elicited moderate to high titers of IgGs which were specific against EBs of serovar E and G except the monovalent MOMP_P3. MOMP_P3 mRNA construct did not give rise to an anti-EB IgG response, as titers were similar to that of the buffer control. Similarly, as shown in FIG. 39, all monovalent and multivalent constructs elicited moderate to high titers of IgGs which were specific against their respective recombinant protein except the monovalent MOMP P3.

Example 14—Synthesis of IM-001 According to Scheme 2

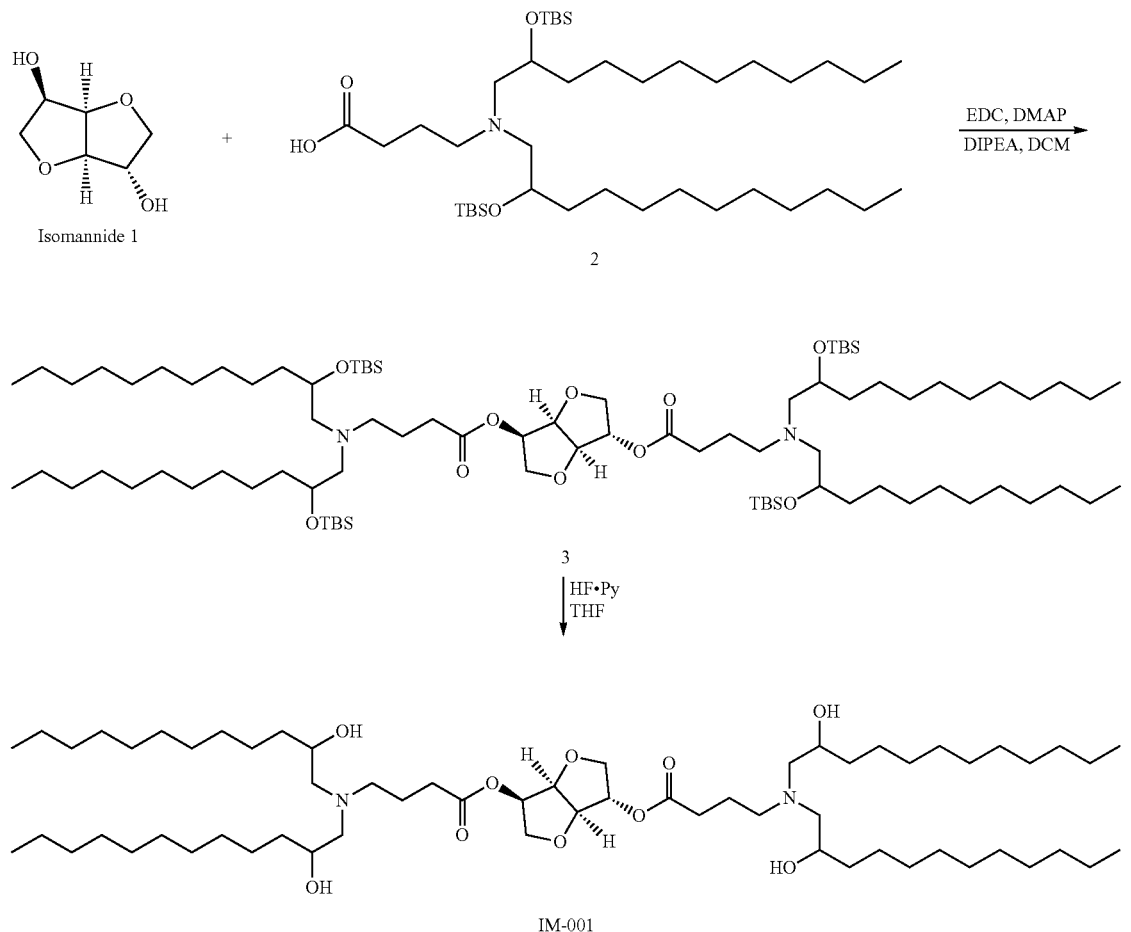

Abbreviations: DCM: Dichloromethane, DIPEA: N,N-Diisopropylethylamine, DMAP: 4-Dimethylaminopyridine, EDC: 1-Ethyl-3-(3-dimethylaminopropyl)carbodiimide, EtOAc: Ethyl acetate, $NaHCO_3$: Sodium hydrogencarbonate, Py: Pyridine, $Na_2SO_4$: Sodium Sulfate, TEA: Triethylamine, TFA: Trifluoroacetic Acid, MS: Mass spectrometry, ESI-MS: Electrospray ionization mass spectrometry, TLC: Thin Layer Chromatography Step 1: Synthesis of Intermediate (3)

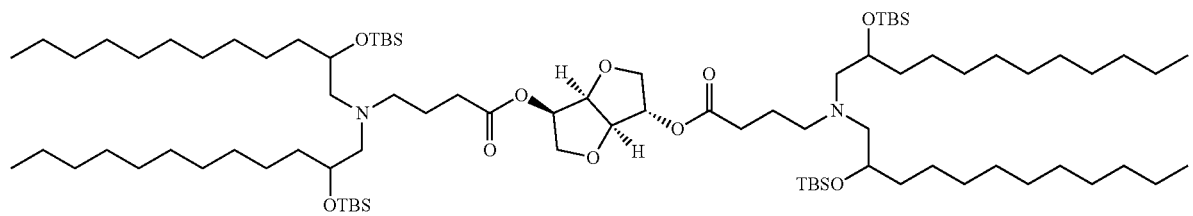 [SMILES: CCCCCCCCCCC(CN(CCCC(=O)O[C@H]1CO[C@H]2[C@@H]1OC[C@H]2OC(=O)CCCN(CC(CCCCCCCCCC)O[Si](C)(C)C(C)(C)C)CC(CCCCCCCCCC)O[Si](C)(C)C(C)(C)C)CC(CCCCCCCCCC)O[Si](C)(C)C(C)(C)C)O[Si](C)(C)C(C)(C)C]

As depicted in Scheme 2: To a solution of acid (2) (1.2 g, 1.71 mmol) and isosorbide (1) (0.100 g, 0.68 mmol) in dichloromethane (10 mL) were added DIPEA (0.95 mL, 5.47 mmol), DMAP (0.084 g, 0.68 mmol) and EDC (0.393 g, 2.05 mmol). The resulting mixture was stirred at room temperature for overnight. After 16 h, MS and TLC (30% EtOAc in hexanes) analysis indicated completion of the reaction. The reaction mixture was diluted with dichloromethane and washed with saturated NaHCO$_3$ solution, water and brine solution. The organic layer was dried over anhydrous Na$_2$SO$_4$ and concentrated. The crude residue was purified, and the desired product was eluted at 6% EtOAc in hexanes. The product containing fractions were concentrated to obtain 0.72 g (69%) of pure product.

Results:

ESI-MS: Calculated $C_{86}H_{177}N_2O_{10}Si_4$, [M+H$^+$]= 1510.25, Observed=1510.3 and 755.4 [M/2+H$^+$]

Step 2: Synthesis of IM-001

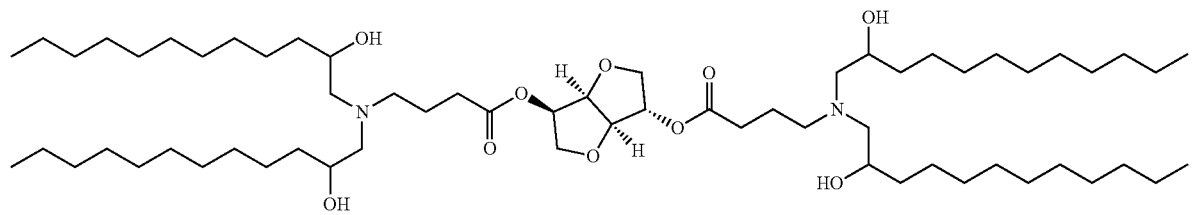 [SMILES: CCCCCCCCCCC(O)CN(CCCC(=O)O[C@H]1CO[C@H]2[C@@H]1OC[C@H]2OC(=O)CCCN(CC(O)CCCCCCCCCC)CC(O)CCCCCCCCCC)CC(O)CCCCCCCCCC]

As depicted in Scheme 2: To a solution of Intermediate (3) (0.72 g, 0.476 mmol) in tetrahydrofuran (4 mL) was added hydrogen fluoride (70% HF.py complex, 2 mL, 14.298 mmol) at 0° C. and stirred at the same temperature for 5 minutes. Then reaction mixture was warmed to room temperature and stirred for 16 h. MS analysis indicated completion of the reaction. The reaction mixture was diluted with ethyl acetate, quenched by slow addition of solid NaHCO$_3$ at 0° C., followed by saturated NaHCO$_3$ solution. The organic layer was washed with sat. NaHCO$_3$ solution, water and brine. Then dried over anhydrous Na$_2$SO$_4$ and concentrated. The crude residue was purified, and the desired product was eluted at 65% EtOAc in hexanes. The purest fractions were concentrated to obtain 0.120 g (24%) of pure product.

Results:

$^1$H NMR (400 MHz, CDCl$_3$) δ 5.30-5.00 (m, 2H), 4.97-4.68 (m, 2H), 4.55-3.71 (m, 8H), 3.57-2.92 (m, 8H), 2.84-2.04 (m, 8H), 1.99-1.01 (m, 76H), 0.88 (t, J=6.8 Hz, 12H).

ESI-MS: Calculated $C_{62}H_{21}N_2O_{10}$, [M+H$^+$]=1053.90, Observed=1053.2 and 527.3 [M/2+H$^+$]

It will be understood that the invention has been described by way of example only and modifications may be made whilst remaining within the scope and spirit of the invention.

REFERENCES

[1] Murray S M, et al. (2021). *Chlamydia trachomatis*: Cell biology, immunology and vaccination. Vaccine. 39(22): 2965-2975. (PMID: 33771390)

[2] de la Maza, et al. (2021). *Chlamydia trachomatis* vaccines for genital infections: where are we and how far is there to go?. Expert review of vaccines, 20(4), 421-435. (PMID: 33682583)

[3] Murray S M, et al. (2021). *Chlamydia trachomatis*: Cell biology, immunology and vaccination. Vaccine. 39(22): 2965-2975. (PMID: 33771390))

[4] Murray S M, et al. (2021). *Chlamydia trachomatis*: Cell biology, immunology and vaccination. Vaccine. 39(22): 2965-2975. (PMID: 33771390)

[5] Witkin S S, et al. (2017). *Chlamydia trachomatis*: the Persistent Pathogen. Clin Vaccine Immunol. 4(10). (PMID: PMC5629669)

[6] Malhotra M, et al. (2013). Genital *Chlamydia trachomatis*: an update. Indian J Med Res. 138(3):303-16. (PMID: 24135174)); Witkin S S, et al. (2017). *Chlamydia trachomatis*: the Persistent Pathogen. Clin Vaccine Immunol. 4(10). (PMID: PMC5629669))

[7] Malhotra M, et al. (2013). Genital *Chlamydia trachomatis*: an update. Indian J Med Res. 138(3):303-16. (PMID: 24135174)

[8] Sun G, et al. (2007). Structural and functional analyses of the major outer membrane protein of *Chlamydia trachomatis*. J Bacteriol. 189(17):6222-35. (PMID: 17601785)

[9] Caldwell H D, et al. (1981). Purification and partial characterization of the major outer membrane protein of *Chlamydia trachomatis*. Infect Immun. (3):1161-76. (PMID: 7228399)

[10] Phillips S, et al. (2019). Seventy Years of *Chlamydia* Vaccine Research—Limitations of the Past and Directions for the Future. Front Microbiol. 10:70. (PMID: 30766521)

[11] Baehr W, et al. (1988). Mapping antigenic domains expressed by *Chlamydia trachomatis* major outer membrane protein genes. PNAS 85(11): 4000-4004. (PMID: 2453883)

[12] Stephens R S, et al. (1987). Diversity of *Chlamydia trachomatis* major outer membrane protein genes. J Bacteriol. 169(9):3879-85. (PMID: 3040664)

[13] Fitch W M, et al. (1993). Phylogenetic analysis of the outer-membrane-protein genes of Chlamydiae, and its implication for vaccine development. Mol Biol Evol. 10(4):892-913. (PMID: 8355605)

[14] Stephens R S, et al. (1987). Diversity of *Chlamydia trachomatis* major outer membrane protein genes. J Bacteriol. 169(9):3879-85. (PMID: 3040664)
[15] Caldwell H D, et al. (1982). Neutralization of *Chlamydia trachomatis* infectivity with antibodies to the major outer membrane protein. Infect Immun. 38(2):745-54 (PMID: 7141712)
[16] Peeling R, et al. (1984). In vitro neutralization of *Chlamydia trachomatis* with monoclonal antibody to an epitope on the major outer membrane protein. Infect Immun. 1984 November; 46(2):484-8 (PMID: 6209221)
[17] Zhang Y X, et al. (1987). Protective monoclonal antibodies recognize epitopes located on the major outer membrane protein of *Chlamydia trachomatis*. J Immunol. 138(2):575-81 (PMID: 3540122)
[18] Zhang Y X, et al. (1987). Protective monoclonal antibodies recognize epitopes located on the major outer membrane protein of *Chlamydia trachomatis*. J Immunol. 138(2):575-81 (PMID: 3540122)
[19] Cotter T W, et al. (1995). Protective efficacy of major outer membrane protein-specific immunoglobulin A (IgA) and IgG monoclonal antibodies in a murine model of *Chlamydia trachomatis* genital tract infection. Infect Immun. 63(12):4704-14. (PMID: 7591126)
[20] Cohen C R, et al. (2005). Immunoepidemiologic profile of *Chlamydia trachomatis* infection: importance of heat-shock protein 60 and interferon-gamma. J Infect Dis. 192(4):591-9. (PMID: 16028127)
[21] Brunham R C, et al. (1996). The epidemiology of *Chlamydia trachomatis* within a sexually transmitted diseases core group. J Infect Dis. 173(4):950-6. (PMID: 8603976)
[22] Darville T, et al. (2019). Anti-chlamydia IgG and IgA are insufficient to prevent endometrial chlamydia infection in women, and increased anti-chlamydia IgG is associated with enhanced risk for incident infection. Am J Reprod Immunol. 81(5). (PMID: 30784128); Russell A N, et al. (2016). Analysis of Factors Driving Incident and Ascending Infection and the Role of Serum Antibody in *Chlamydia trachomatis* Genital Tract Infection. J Infect Dis. 213(4):523-31. (PMID: 26347571); Liu C, et al. (2022). Reduced Endometrial Ascension and Enhanced Reinfection Associated With Immunoglobulin G Antibodies to Specific *Chlamydia trachomatis* Proteins in Women at Risk for *Chlamydia*. J Infect Dis. 225(5):846-855. (PMID: 34610131); Ohman H, et al. (2020). Prevalence and persistence of *Chlamydia trachomatis*-specific antibodies after occasional and recurrent infections. Sex Transm Infect. 96(4):277-282. (PMID: 31320394); Collar A L, et al. (2020). Antibodies to Variable Domain 4 Linear Epitopes of the *Chlamydia trachomatis* Major Outer Membrane Protein Are Not Associated with *Chlamydia* Resolution or Reinfection in Women. mSphere. 5(5). (PMID: 32968007)
[23] Morrison S G, et al. (2005). A predominant role for antibody in acquired immunity to chlamydial genital tract reinfection. J Immunol. 175(11):7536-42. (PMID: 16301662)
[24] Fadel S, et al. (2007). *Chlamydia trachomatis* OmcB protein is a surface-exposed glycosaminoglycan-dependent adhesin. J Med Microbiol. 56(Pt 1):15-22. (PMID: 17172511)
[25] Finco O, et al. (2011). Approach to discover T- and B-cell antigens of intracellular pathogens applied to the design of *Chlamydia trachomatis* vaccines. Proc Natl Acad Sci USA. 108(24):9969-74. (PMID: 21628568)
[26] Qi M, et al. (2011). A *Chlamydia trachomatis* OmcB C-terminal fragment is released into the host cell cytoplasm and is immunogenic in humans. Infect Immun. 79(6):2193-203. (PMID: 21422182)
[27] Olsen A W, et al. (2010). Protection against *Chlamydia* promoted by a subunit vaccine (CTH1) compared with a primary intranasal infection in a mouse genital challenge model. PLoS One. 5(5). (PMID: 20505822)
[28] Olsen A W, et al. (2014). Characterization of protective immune responses promoted by human antigen targets in a urogenital *Chlamydia trachomatis* mouse model. Vaccine. 32(6):685-92. (PMID: 24365515)
[29] Markham A P, et al. (2009). Biophysical characterization of *Chlamydia trachomatis* CT584 supports its potential role as a type III secretion needle tip protein. Biochemistry. 48(43):10353-61. (PMID: 19769366)
[30] Markham A P, et al. (2009). Biophysical characterization of *Chlamydia trachomatis* CT584 supports its potential role as a type III secretion needle tip protein. Biochemistry. 48(43):10353-61. (PMID: 19769366)
[31] Paes W, et al. (2016). Recombinant polymorphic membrane protein D in combination with a novel, second-generation lipid adjuvant protects against intra-vaginal *Chlamydia trachomatis* infection in mice. Vaccine. 34(35):4123-4131. (PMID: 27389169)
[32] Paes W, et al. (2018). The *Chlamydia trachomatis* PmpD adhesin forms higher order structures through disulphide-mediated covalent interactions. PloS one, 13(6), e0198662. (PMID: 29912892)

Sequences

TABLE 10

| | Protein sequences | | |
|---|---|---|---|
| SEQ ID NO | name | nt SEQ ID NO(*) | other name |
| | Full Length constructs | | |
| 21 | MOMP_serD_FL_ssHA1 | 879 294 | |
| 22 | MOMP_serD_FL_ssHA2 | 301 302 | |
| 23 | MOMP_serD_FL_ssHA1_C2S | 295 296 | |
| 24 | MOMP_serD_FL_ssHA2_C2S | 303 304 | |
| 25 | MOMP_serD_FL_ssHA1_Glycneg | 298 297 | |
| 26 | MOMP_serD_FL_ssHA2_Glycneg | 305 306 | |
| 27 | MOMP_serD_FL_ssHA1_C2S_Glycneg | 873 300 | |
| 28 | MOMP_serD_FL_ssHA2_C2S_Glycneg | 307 308 | |
| 29 | MOMP_serE_FL_ssHA1 | 875 309 | |
| 30 | MOMP_serE_FL_ssHA2 | 317 318 | |
| 31 | MOMP_serE_FL_ssHA1_C2S | 311 312 | |
| 32 | MOMP_serE_FL_ssHA2_C2S | 319 320 | |

TABLE 10-continued

Protein sequences

| SEQ ID NO | name | nt SEQ ID NO(*) | other name |
|---|---|---|---|
| 33 | MOMP__serE__FL__ssHA1__Glycneg | 314 313 | |
| 34 | MOMP__serE__FL__ssHA2__Glycneg | 321 322 | |
| 35 | MOMP__serE__FL__ssHA1__C2S__Glycneg | 876 316 | |
| 36 | MOMP__serE__FL__ssHA2__C2S__Glycneg | 323 324 | |
| 37 | MOMP__serF__FL__ssHA1 | 880 326 | |
| 38 | MOMP__serF__FL__ssHA2 | 333 334 | |
| 39 | MOMP__serF__FL__ssHA1__C2S | 327 328 | |
| 40 | MOMP__serF__FL__ssHA2__C2S | 335 336 | |
| 41 | MOMP__serF__FL__ssHA1__Glycneg | 329 330 | |
| 42 | MOMP__serF__FL__ssHA2__Glycneg | 338 337 | |
| 43 | MOMP__serF__FL__ssHA1__C2S__Glycneg | 331 332 | |
| 44 | MOMP__serF__FL__ssHA2__C2S__Glycneg | 339 340 | |
| 45 | MOMP__serG__FL__ssHA1 | 881 342 | |
| 46 | MOMP__serG__FL__ssHA2 | 349 350 | |
| 47 | MOMP__serG__FL__ssHA1__C2S | 343 874 | |
| 48 | MOMP__serG__FL__ssHA2__C2S | 351 352 | |
| 49 | MOMP__serG__FL__ssHA1__Glycneg | 345 346 | |
| 50 | MOMP__serG__FL__ssHA2__Glycneg | 353 354 | |
| 51 | MOMP__serG__FL__ssHA1__C2S__Glycneg | 347 348 | |
| 52 | MOMP__serG__FL__ssHA2__C2S__Glycneg | 355 356 | |
| | T cell constructs | | |
| 53 | MOMP__P3__ssHA1 | 213 214 | |
| 54 | MOMP__P3__ssHA2 | 215 216 | |
| 55 | MOMP__P3__ssHA1__C2S | 218 217 | |
| 56 | MOMP__P3__ssHA2__C2S | 219 220 | |
| 57 | MOMP__P5__ssHA1 | 222 221 | |
| 58 | MOMP__P5__ssHA2 | 223 224 | |
| 59 | MOMP__P5__ssHA1__C2S | 225 226 | |
| 60 | MOMP__P5__ssHA2__C2S | 227 228 | |
| | VD constructs | | |
| 61 | MOMP__VDcomb1-extP__ssHA1 | 863 229 | |
| 62 | MOMP__VDcomb1-extP__ssHA2 | 237 238 | |
| 63 | MOMP__VDcomb1-extP__ssHA1__Glycneg | 877 232 | |
| 64 | MOMP__VDcomb1-extP__ssHA2__Glycneg | 239 240 | |
| 65 | MOMP__VDcomb1-extP__ssHA1__TMB1 | 233 234 | |
| 66 | MOMP__VDcomb1-extP__ssHA2__TMB2 | 241 242 | |
| 67 | MOMP__VDcomb1-extP__ssHA1__TMB1__Glycneg | 865 235 | |
| 68 | MOMP__VDcomb1-extP__ssHA2__TMB2__Glycneg | 243 244 | |
| 69 | MOMP__VDcomb1-extS__ssHA1 | 864 245 | |
| 70 | MOMP__VDcomb1-extS__ssHA2 | 253 254 | |
| 71 | MOMP__VDcomb1-extS__ssHA1__Glycneg | 878 248 | |
| 72 | MOMP__VDcomb1-extS__ssHA2__Glycneg | 255 256 | |
| 73 | MOMP__VDcomb1-extS__ssHA1__TMB1 | 249 250 | |
| 74 | MOMP__VDcomb1-extS__ssHA2__TMB2 | 257 258 | |
| 75 | MOMP__VDcomb1-extS__ssHA1__TMB1__Glycneg | 866 251 | |
| 76 | MOMP__VDcomb1-extS__ssHA2__TMB2__Glycneg | 259 260 | |
| 77 | MOMP__VDcomb2-extP__ssHA1 | 261 262 | |
| 78 | MOMP__VDcomb2-extP__ssHA2 | 269 270 | |
| 79 | MOMP__VDcomb2-extP__ssHA1__Glycneg | 868 264 | |
| 80 | MOMP__VDcomb2-extP__ssHA2__Glycneg | 869 272 | |
| 81 | MOMP__VDcomb2-extP__ssHA1__TMB1 | 265 266 | |
| 82 | MOMP__VDcomb2-extP__ssHA2__TMB2 | 273 274 | |
| 83 | MOMP__VDcomb2-extP__ssHA1__TMB1__Glycneg | 871 268 | |
| 84 | MOMP__VDcomb2-extP__ssHA2__TMB2__Glycneg | 867 276 | |
| 85 | MOMP__VDcomb2-extS__ssHA1 | 277 278 | |
| 86 | MOMP__VDcomb2-extS__ssHA2 | 285 286 | |
| 87 | MOMP__VDcomb2-extS__ssHA1__Glycneg | 870 280 | |
| 88 | MOMP__VDcomb2-extS__ssHA2__Glycneg | 287 288 | |
| 89 | MOMP__VDcomb2-extS__ssHA1__TMB1 | 872 282 | |
| 90 | MOMP__VDcomb2-extS__ssHA2__TMB2 | 289 290 | |
| 91 | MOMP__VDcomb2-extS__ssHA1__TMB1__Glycneg | 283 284 | |
| 92 | MOMP__VDcomb2-extS__ssHA2__TMB2__Glycneg | 291 292 | |
| | BENCHMARK constructs | | |
| 93 | Hirep2__ssHA1 | 862 202 | |
| 94 | Hirep2__ssHA1__TMB1 | 203 204 | |
| 95 | Hirep2__ssHA1__Glycneg | 205 206 | |
| 96 | Hirep2__ssHA1__TMB1__Glycneg | 207 208 | |
| 97 | CTH522__ssHA1 | 209 210 | |
| 98 | CTH522__ssHA1__Glycneg | 211 212 | |
| 99 | Hirep2__patent__ssHA1 | 357 358 | |
| 100 | Hirep2__patent__ssHA1__TMB1 | 359 360 | |
| 101 | Hirep2__patent__ssHA1__Glycneg | 361 362 | |

TABLE 10-continued

Protein sequences

| SEQ ID NO | name | nt SEQ ID NO(*) | other name |
|---|---|---|---|
| 102 | Hirep2_patent_ssHA1_TMB1_Glycneg | 363 364 | |
| 103 | CTH522_patent_ssHA1 | 366 365 | |
| 104 | CTH522_patent_ssHA1_Glycneg | 367 368 | |
| | CT443 | | |
| 105 | CT443_ssHA1 | 369 370 | |
| 106 | CT443_ssHA1_Glycneg | 371 372 | |
| | CT584 | | |
| 107 | CT584_ssHA1 | 374 373 | |
| 108 | CT584_ssHA1_Glycneg | 377 378 | |
| 109 | CT584_ssHA1_C2S | 376 375 | |
| 110 | CT584_ssHA1_Glycneg_C2S | 379 380 | |
| | CT600 | | |
| 111 | CT600_trunc_ssHA1 | 381 382 | |
| 112 | CT600_trunc_ssHA1_Glycneg | 383 384 | |
| | CT812 | | |
| 113 | CT812_pass-domain_ssHA1 | 385 386 | |
| 114 | CT812_pass-domain_ssHA1_C2S | 388 387 | |
| 115 | CT812_ext-pass-domain_ssHA1 | 389 390 | |
| 116 | CT812_ext-pass-domain_ssHA1_C2S | 391 392 | |
| 117 | CT812_pass-domain_ssHA1_HPX1-1_HPX2-1 | 399 400 | |
| 118 | CT812_pass-domain_ssHA1_HPX1-1_HPX2-3 | 411 412 | |
| 119 | CT812_pass-domain_ssHA1_HPX1-2_HPX2-1 | 393 394 | |
| 120 | CT812_pass-domain_ssHA1_HPX1-2_HPX2-3 | 405 406 | |
| 121 | CT812_pass-domain_ssHA1_HPX1-1_HPX2-1_C2S | 413 414 | |
| 122 | CT812_pass-domain_ssHA1_HPX1-1_HPX2-3_C2S | 417 418 | |
| 123 | CT812_pass-domain_ssHA1_HPX1-2_HPX2-1_C2S | 395 396 | |
| 124 | CT812_pass-domain_ssHA1_HPX1-2_HPX2-3_C2S | 407 408 | |
| 125 | CT812_ext-pass-domain_ssHA1_HPX1-1_HPX2-1 | 403 404 | |
| 126 | CT812_ext-pass-domain_ssHA1_HPX1-1_HPX2-3 | 401 402 | |
| 127 | CT812_ext-pass-domain_ssHA1_HPX1-2_HPX2-1 | 421 422 | |
| 128 | CT812_ext-pass-domain_ssHA1_HPX1-2_HPX2-3 | 419 420 | |
| 129 | CT812_ext-pass-domain_ssHA1_HPX1-1_HPX2-1_C2S | 423 424 | |
| 130 | CT812_ext-pass-domain_ssHA1_HPX1-1_HPX2-3_C2S | 415 416 | |
| 131 | CT812_ext-pass-domain_ssHA1_HPX1-2_HPX2-1_C2S | 409 410 | |
| 132 | CT812_ext-pass-domain_ssHA1_HPX1-2_HPX2-3_C2S | 397 398 | |
| | T cell MOMP protein | | |
| 133 | MOMP_P5_6his_coli | | |
| | Full Length MOMP protein | | |
| 134 | MOMP_SerE_FL_Wt | | |
| 135 | MOMP_serE_FL_6his_coli | | |
| 136 | MOMP_serE_FL_C2S_6his_coli | | |
| | BENCHMARK constructs protein | | |
| 142 | rec SSI CTH522_6his_coli | | |
| | Non-MOMP constructs | | |
| 143 | CT443_6his_coli | 538 | |
| 144 | CT443NterTrunc_6his_coli | | |
| 145 | 6his_CT584_coli | 536 | |

TABLE 10-continued

Protein sequences

| SEQ ID NO | name | nt SEQ ID NO(*) | other name |
|---|---|---|---|
| 197 | rCT812 | | |
| 198 | rCT443 | | |
| | Pilot constructs | | |
| 148 | MC3 MOMP or MC3 SER E MOMP | 425 | OmpA Serovar E |
| 149 | MC3 MOMP (human leader) or MC3 SER E MOMP human leader | 426 | OmpA Serovar E w/Human Leader |
| 150 | OmpA Serovar E w/Human Leader | | |
| 151 | OF-02 MOMP or OF-02 SER E MOMP | 425 | OmpA Serovar E |
| 152 | OF-02 MOMP (human leader) or OF-02 SER E MOMP human leader | 426 | OmpA Serovar E w/Human Leader |
| 153 | — | 427 | OmpA Serovar D w/Human Leader |
| 154 | mRNA MOMP WT | 425 | OmpA Serovar E |
| 155 | mRNA MNR MOMP E FL MRT12514 | 861 | MNR CT-681 (wild type)-no tag |
| 156 | mRNA MOMP ΔVD4 | 428 | MOMP/D-VD4 |
| 157 | mRNA MOMP ΔVD24 or mRNA UNR MOMPE DII:IV | 429 | MOMP/D-VD2_VD4 |
| 158 | mRNA MOMP ΔVD24 | 430 | MOMP/D-VD1_VD2_VD4 |
| 159 | mRNA MOMP ΔVD1234 | 431 | MOMP/D-VD3_VD1_VD2_VD4 |
| 160 | mRNA MOMP Δsignal peptide | 432 | MOMP/D-signalpep |
| 161 | mRNA MOMP ΔVD124 | 452 | MOMP:DVD1 |
| 162 | mRNA MOMP ΔVD2 | 453 | MOMP:DVD2 |
| 163 | mRNA MOMP ΔVD3 | 454 | MOMP:DVD3 |
| 164 | mRNA MOMP ΔVD23 | 455 | MOMP:DVD2:DVD3 |
| 165 | mRNA MOMP ΔVD123 | 456 | MOMP:DVD1:DVD2:DVD3 |
| 166 | mRNA MOMP ΔVD234 | 457 | MOMP:DVD2:DVD3:DVD4 |
| 167 | mRNA MOMP ΔVD134 | 458 | MOMP:DVD1:DVD3:DVD4 |
| 168 | CT812: 1-1530 | 433 | CT812: 1-1530 |
| 169 | CT812: 1-761 | 434 | CT812: 1-761 |
| 170 | Nan96-SS:CT812: 32-761 or CT812 | 435 | Nan96-SS:CT812: 32-761 |
| 171 | CT600: 1-188 | 436 | CT600: 1-188 |
| 172 | Nan96-SS:CT600: 2-188 or CT600 | 437 | Nan96HA-SS:CT600: 2-188 |
| 173 | CT443: 1-576 | 438 | CT443: 1-576 |
| 174 | Nan96-SS:CT443: 32-576 or CT443 | 439 | Nan96HA-SS:CT443: 32-576 |
| 175 | CT584: 1-183 | 440 | CT584: 1-183 |
| 176 | CT584: 1-183* | 441 | CT584: 1-183* |
| 177 | Nan96HA-SS:CT584: 2-183 or CT584 | 442 | Nan96HA-SS:CT584: 2-183 |
| | BENCHMARK constructs | | |
| 506 | Hirep2 | | |
| 841 | Hirep2_patent | 695 696 | |
| 842 | CTH522 | | |
| 843 | CTH522_patent | | |

(*)for protein sequences where two corresponding nucleic acid sequences are mentioned, the first sequence was tested in mice (where applicable)

TABLE 11

Sequence information

| SEQ ID NO: | Name |
|---|---|
| | P3 and P5 VD loops |
| 462 | VD1_P3 |
| 463 | VD2_P3 |
| 464 | VD3_P3 |
| 465 | VD4_P3 |
| 466 | VD1_P5 |
| 467 | VD2_P5 |
| 468 | VD3_P5 |
| 469 | VD4_P5 |
| | MOMP proteins without SS |
| 470 | MOMP_serD_FL |
| 471 | MOMP_serD_FL_C2S |
| 472 | MOMP_serD_FL_Glycneg |
| 473 | MOMP_serD_FL_C2S_Glycneg |
| 474 | MOMP_serE_FL |
| 475 | MOMP_serE_FL_C2S |
| 476 | MOMP_serE_FL_Glycneg |
| 477 | MOMP_serE_FL_C2S_Glycneg |
| 478 | MOMP_serF_FL |
| 479 | MOMP_serF_FL_C2S |
| 480 | MOMP_serF_FL_Glycneg |
| 481 | MOMP_serF_FL_C2S_Glycneg |
| 482 | MOMP_serG_FL |
| 483 | MOMP_serG_FL_C2S |
| 484 | MOMP_serG_FL_Glycneg |
| 485 | MOMP_serG_FL_C2S_Glycneg |
| | T cell constructs |
| 486 | MOMP_P3 |
| 487 | MOMP_P3_C2S |
| 488 | MOMP_P5 |
| 489 | MOMP_P5_C2S |

TABLE 11-continued

Sequence information

| SEQ ID NO: | Name |
|---|---|
| | VD constructs |
| 490 | MOMP_VDcomb1-extP |
| 491 | MOMP_VDcomb1-extP_Glycneg |
| 492 | MOMP_VDcomb1-extP_TMB1 |
| 493 | MOMP_VDcomb1-extP_TMB1_Glycneg |
| 494 | MOMP_VDcomb1-extS |
| 495 | MOMP_VDcomb1-extS_Glycneg |
| 496 | MOMP_VDcomb1-extS_TMB1 |
| 499 | MOMP_VDcomb2-extP_Glycneg |
| 500 | MOMP_VDcomb2-extP_TMB1 |
| 501 | MOMP_VDcomb2-extP_TMB1_Glycneg |
| 502 | MOMP_VDcomb2-extS |
| 503 | MOMP_VDcomb2-extS_Glycneg |
| 504 | MOMP_VDcomb2-extS_TMB1 |
| 505 | MOMP_VDcomb2-extS_TMB1_Glycneg |
| | non-MOMP proteins without SS |
| 507 | CT443 |
| 508 | CT443_Glycneg |
| | CT584 |
| 509 | CT584 |
| 510 | CT584_Glycneg |
| 511 | CT584_C2S |
| 512 | CT584_Glycneg_C2S |
| | CT600 |
| 844 | CT600_ref |
| 513 | CT600_trunc |
| 514 | CT600_trunc_Glycneg |
| | CT812 |
| 515 | CT812_ref |
| 516 | CT812_pass-domain |
| 517 | CT812_pass-domain_C2S |
| 518 | CT812_ext-pass-domain |
| 519 | CT812_ext-pass-domain_C2S |
| 520 | CT812_pass-domain_HPX1-1_HPX2-1 |
| 521 | CT812_pass-domain_HPX1-1_HPX2-3 |
| 522 | CT812_pass-domain_HPX1-2_HPX2-1 |
| 523 | CT812_pass-domain_HPX1-2_HPX2-3 |
| 524 | CT812_pass-domain_HPX1-1_HPX2-1_C2S |
| 525 | CT812_pass-domain_HPX1-1_HPX2-3_C2S |
| 526 | CT812_pass-domain_HPX1-2_HPX2-1_C2S |
| 527 | CT812_pass-domain_HPX1-2_HPX2-3_C2S |
| 528 | CT812_ext-pass-domain_HPX1-1_HPX2-1 |
| 529 | CT812_ext-pass-domain_HPX1-1_HPX2-3 |
| 530 | CT812_ext-pass-domain_HPX1-2_HPX2-1 |
| 531 | CT812_ext-pass-domain_HPX1-2_HPX2-3 |
| 532 | CT812_ext-pass-domain_HPX1-1_HPX2-1_C2S |
| 533 | CT812_ext-pass-domain_HPX1-1_HPX2-3_C2S |

TABLE 12

Nucleic acid sequences

| SEQ ID NO: | Construct name | Corresp. SEQ ID NO. (with SS) |
|---|---|---|
| 539 | Hirep2_ssHA1 | 862 |
| 540 | Hirep2_ssHA1 | 202 |
| 541 | Hirep2_ssHA1_TMB1 | 203 |
| 542 | Hirep2_ssHA1_TMB1 | 204 |
| 543 | Hirep2_ssHA1_Glycneg | 205 |
| 544 | Hirep2_ssHA1_Glycneg | 206 |
| 545 | Hirep2_ssHA1_TMB1_Glycneg | 207 |
| 546 | Hirep2_ssHA1_TMB1_Glycneg | 208 |
| 547 | CTH522_ssHA1 | 209 |
| 548 | CTH522_ssHA1 | 210 |
| 549 | CTH522_ssHA1_Glycneg | 211 |
| 550 | CTH522_ssHA1_Glycneg | 212 |
| 551 | MOMP_P3_ssHA1 | 213 |
| 552 | MOMP_P3_ssHA1 | 214 |
| 553 | MOMP_P3_ssHA2 | 215 |
| 554 | MOMP_P3_ssHA2 | 216 |
| 555 | MOMP_P3_ssHA1_C2S | 217 |
| 556 | MOMP_P3_ssHA1_C2S | 218 |
| 557 | MOMP_P3_ssHA2_C2S | 219 |
| 558 | MOMP_P3_ssHA2_C2S | 220 |
| 559 | MOMP_P5_ssHA1 | 221 |
| 560 | MOMP_P5_ssHA1 | 222 |
| 561 | MOMP_P5_ssHA2 | 223 |
| 562 | MOMP_P5_ssHA2 | 224 |
| 563 | MOMP_P5_ssHA1_C2S | 225 |
| 564 | MOMP_P5_ssHA1_C2S | 226 |
| 565 | MOMP_P5_ssHA2_C2S | 227 |
| 566 | MOMP_P5_ssHA2_C2S | 228 |
| 567 | MOMP_VDcomb1-extP_ssHA1 | 229 |
| 568 | MOMP_VDcomb1-extP_ssHA1 | 863 |
| 569 | MOMP_VDcomb1-extP_ssHA1_Glycneg | 877 |
| 570 | MOMP_VDcomb1-extP_ssHA1_Glycneg | 232 |
| 571 | MOMP_VDcomb1-extP_ssHA1_TMB1 | 233 |
| 572 | MOMP_VDcomb1-extP_ssHA1_TMB1 | 234 |
| 573 | MOMP_VDcomb1-extP_ssHA1_TMB1_Glycneg | 235 |
| 574 | MOMP_VDcomb1-extP_ssHA1_TMB1_Glycneg | 865 |

TABLE 12-continued

Nucleic acid sequences

| SEQ ID NO: | Construct name | Corresp. SEQ ID NO. (with SS) |
|---|---|---|
| 575 | MOMP_VDcomb1-extP_ssHA2 | 237 |
| 576 | MOMP_VDcomb1-extP_ssHA2 | 238 |
| 577 | MOMP_VDcomb1-extP_ssHA2_Glycneg TABLE 12-continued Nucleic acid sequences

| SEQ ID NO: | Construct name | Corresp. SEQ ID NO. (with SS) |
|---|---|---|
| 648 | MOMP_serE_FL_ssHA1 | 875 |
| 649 | MOMP_serE_FL_ssHA1_C2S | 311 |
| 650 | MOMP_serE_FL_ssHA1_C2S | 312 |
| 651 | MOMP_serE_ssHA1_Glycneg | 313 |
| 652 | MOMP_serE_ssHA1_Glycneg | 314 |
| 653 | MOMP_serE_ssHA1_C2S_Glycneg | 876 |
| 654 | MOMP_serE_ssHA1_C2S_Glycneg | 316 |
| 655 | MOMP_serE_FL_ssHA2 | 317 |
| 656 | MOMP_serE_FL_ssHA2 | 318 |
| 657 | MOMP_serE_FL_ssHA2_C2S | 319 |
| 658 | MOMP_serE_FL_ssHA2_C2S | 320 |
| 659 | MOMP_serE_ssHA2_Glycneg | 321 |
| 660 | MOMP_serE_ssHA2_Glycneg | 322 |
| 661 | MOMP_serE_ssHA2_C2S_Glycneg | 323 |
| 662 | MOMP_serE_ssHA2_C2S_Glycneg | 324 |
| 663 | MOMP_serF_FL_ssHA1 | 880 |
| 664 | MOMP_serF_FL_ssHA1 | 326 |
| 665 | MOMP_serF_FL_ssHA1_C2S | 327 |
| 666 | MOMP_serF_FL_ssHA1_C2S | 328 |
| 667 | MOMP_serF_FL_ssHA1_Glycneg | 329 |
| 668 | MOMP_serF_FL_ssHA1_Glycneg | 330 |
| 669 | MOMP_serF_FL_ssHA1_C2S_Glycneg | 331 |
| 670 | MOMP_serF_FL_ssHA1_C2S_Glycneg | 332 |
| 671 | MOMP_serF_FL_ssHA2 | 333 |
| 672 | MOMP_serF_FL_ssHA2 | 334 |
| 673 | MOMP_serF_FL_ssHA2_C2S | 335 |
| 674 | MOMP_serF_FL_ssHA2_C2S | 336 |
| 675 | MOMP_serF_FL_ssHA2_Glycneg | 337 |
| 676 | MOMP_serF_FL_ssHA2_Glycneg | 338 |
| 677 | MOMP_serF_FL_ssHA2_C2S_Glycneg | 339 |
| 678 | MOMP_serF_FL_ssHA2_C2S_Glycneg | 340 |
| 679 | MOMP_serG_FL_ssHA1 | 881 |
| 680 | MOMP_serG_FL_ssHA1 | 342 |
| 681 | MOMP_serG_FL_ssHA1_C2S | 343 |
| 682 | MOMP_serG_FL_ssHA1_C2S | 874 |
| 683 | MOMP_serG_FL_ssHA1_Glycneg | 345 |
| 684 | MOMP_serG_FL_ssHA1_Glycneg | 346 |
| 685 | MOMP_serG_FL_ssHA1_C2S | 347 |
| 686 | MOMP_serG_FL_ssHA1_C2S | 348 |
| 687 | MOMP_serG_FL_ssHA2 | 349 |
| 688 | MOMP_serG_FL_ssHA2 | 350 |
| 689 | MOMP_serG_FL_ssHA2_C2S | 351 |
| 690 | MOMP_serG_FL_ssHA2_C2S | 352 |
| 691 | MOMP_serG_FL_ssHA2_Glycneg | 353 |
| 692 | MOMP_serG_FL_ssHA2_Glycneg | 354 |
| 693 | MOMP_serG_FL_ssHA2_C2S | 355 |
| 694 | MOMP_serG_FL_ssHA2_C2S | 356 |
| 695 | Hirep2_patent_ssHA1 [CO1] PolyA | 357 |
| 696 | Hirep2_patent_ssHA1 [CO2] PolyA | 358 |
| 697 | Hirep2_patent_ssHA1_TMB1 [CO1] PolyA | 359 |
| 698 | Hirep2_patent_ssHA1_TMB1 [CO2] PolyA | 360 |
| 699 | Hirep2_patent_ssHA1_Glycneg [CO1] PolyA | 361 |
| 700 | Hirep2_patent_ssHA1_Glycneg [CO2] PolyA | 362 |
| 701 | Hirep2_patent_ssHA1_TMB1_Glycneg [CO1] PolyA | 363 |
| 702 | Hirep2_patent_ssHA1_TMB1_Glycneg [CO2] PolyA | 364 |
| 703 | CTH522_patent_ssHA1 [CO1] PolyA | 365 |
| 704 | CTH522_patent_ssHA1 [CO2] PolyA | 366 |
| 705 | CTH522_patent_ssHA1_Glycneg [CO1] PolyA | 367 |
| 706 | CTH522_patent_ssHA1_Glycneg [CO2] PolyA | 368 |
| 707 | CT443_ssHA1 PolyA | 369 |
| 708 | CT443_ssHA1 PolyA | 370 |
| 709 | CT443_ssHA1_Glycneg PolyA | 371 |
| 710 | CT443_ssHA1_Glycneg PolyA | 372 |
| 711 | CT584_ssHA1 PolyA | 373 |
| 712 | CT584_ssHA1 PolyA | 374 |
| 713 | CT584_ssHA1_C2S PolyA | 375 |
| 714 | CT584_ssHA1_C2S PolyA | 376 |
| 715 | CT584_ssHA1_Glycneg PolyA | 377 |
| 716 | CT584_ssHA1_Glycneg PolyA | 378 |
| 717 | CT584_ssHA1_Glycneg_C2S PolyA | 379 |
| 718 | CT584_ssHA1_Glycneg_C2S PolyA | 380 |
| 719 | CT600_trunc_ssHA1 PolyA | 381 |
| 720 | CT600_trunc_ssHA1 PolyA | 382 |

TABLE 12-continued

Nucleic acid sequences

| SEQ ID NO: | Construct name | Corresp. SEQ ID NO. (with SS) |
|---|---|---|
| 721 | CT600_trunc_ssHA1_Glycneg PolyA | 383 |
| 722 | CT600_trunc_ssHA1_Glycneg PolyA | 384 |
| 723 | CT812_pass-domain_ssHA1 PolyA | 385 |
| 724 | CT812_pass-domain_ssHA1 PolyA | 386 |
| 725 | CT812_pass-domain_ssHA1_C2S PolyA | 387 |
| 726 | CT812_pass-domain_ssHA1_C2S PolyA | 388 |
| 727 | CT812_ext-pass-domain_ssHA1 PolyA | 389 |
| 728 | CT812_ext-pass-domain_ssHA1 PolyA | 390 |
| 729 | CT812_ext-pass-domain_ssHA1_C2S PolyA | 391 |
| 730 | CT812_ext-pass-domain_ssHA1_C2S PolyA | 392 |
| 731 | CT812_pass-domain_ssHA1_HPX1-2_HPX2-1 CO1 | 393 |
| 732 | CT812_pass-domain_ssHA1_HPX1-2_HPX2-1 CO2 | 394 |
| 733 | CT812_pass-domain_ssHA1_HPX1-2_HPX2-1_C2S CO1 | 395 |
| 734 | CT812_pass-domain_ssHA1_HPX1-2_HPX2-1_C2S CO2 | 396 |
| 735 | CT812_ext-pass-domain_ssHA1_HPX1-2_HPX2-3_C2S CO1 | 397 |
| 736 | CT812_ext-pass-domain_ssHA1_HPX1-2_HPX2-3_C2S CO2 | 398 |
| 737 | CT812_pass-domain_ssHA1_HPX1-1_HPX2-1 CO1 | 399 |
| 738 | CT812_pass-domain_ssHA1_HPX1-1_HPX2-1 CO2 | 400 |
| 739 | CT812_ext-pass-domain_ssHA1_HPX1-1_HPX2-3 CO1 | 401 |
| 740 | CT812_ext-pass-domain_ssHA1_HPX1-1_HPX2-3 CO2 | 402 |
| 741 | CT812_ext-pass-domain_ssHA1_HPX1-1_HPX2-1 CO1 | 403 |
| 742 | CT812_ext-pass-domain_ssHA1_HPX1-1_HPX2-1 CO2 | 404 |
| 743 | CT812_pass-domain_ssHA1_HPX1-2_HPX2-3 CO1 | 405 |
| 744 | CT812_pass-domain_ssHA1_HPX1-2_HPX2-3 CO2 | 406 |
| 745 | CT812_pass-domain_ssHA1_HPX1-2_HPX2-3_C2S CO1 | 407 |
| 746 | CT812_pass-domain_ssHA1_HPX1-2_HPX2-3_C2S CO2 | 408 |
| 747 | CT812_ext-pass-domain_ssHA1_HPX1-2_HPX2-1_C2S CO1 | 409 |
| 748 | CT812_ext-pass-domain_ssHA1_HPX1-2_HPX2-1_C2S CO2 | 410 |
| 749 | CT812_pass-domain_ssHA1_HPX1-1_HPX2-3 CO1 | 411 |
| 750 | CT812_pass-domain_ssHA1_HPX1-1_HPX2-3 CO2 | 412 |
| 751 | CT812_pass-domain_ssHA1_HPX1-1_HPX2-1_C2S CO1 | 413 |
| 752 | CT812_pass-domain_ssHA1_HPX1-1_HPX2-1_C2S CO2 | 414 |
| 753 | CT812_ext-pass-domain_ssHA1_HPX1-1_HPX2-3_C2S CO1 | 415 |
| 754 | CT812_ext-pass-domain_ssHA1_HPX1-1_HPX2-3_C2S CO2 | 416 |
| 755 | CT812_pass-domain_ssHA1_HPX1-1_HPX2-3_C2S CO1 | 417 |
| 756 | CT812_pass-domain_ssHA1_HPX1-1_HPX2-3_C2S CO2 | 418 |
| 757 | CT812_ext-pass-domain_ssHA1_HPX1-2_HPX2-3 CO1 | 419 |
| 758 | CT812_ext-pass-domain_ssHA1_HPX1-2_HPX2-3 CO2 | 420 |
| 759 | CT812_ext-pass-domain_ssHA1_HPX1-2_HPX2-1 CO1 | 421 |
| 760 | CT812_ext-pass-domain_ssHA1_HPX1-2_HPX2-1 CO2 | 422 |
| 761 | CT812_ext-pass-domain_ssHA1_HPX1-1_HPX2-1_C2S CO1 | 423 |
| 762 | CT812_ext-pass-domain_ssHA1_HPX1-1_HPX2-1_C2S CO2 | 424 |
| 763 | | 425 |
| 764 | | 426 |
| 765 | | 427 |
| 766 | | 428 |
| 767 | | 429 |
| 768 | | 430 |
| 769 | | 431 |
| 770 | | 432 |
| 771 | | 433 |
| 772 | | 434 |
| 773 | | 435 |
| 774 | | 436 |
| 775 | | 437 |
| 776 | | 438 |
| 777 | | 439 |
| 778 | | 440 |
| 779 | | 441 |
| 780 | | 442 |
| 790 | | 452 |
| 791 | | 453 |
| 792 | | 454 |
| 793 | | 455 |
| 794 | | 456 |
| 795 | | 457 |
| 796 | | 458 |
| 797 | | 861 |
| 800 | | 536 |
| 801 | | 537 |
| 802 | | 538 |

SEQUENCE LISTING (885 sequences)

SEQ ID NO: 1 - protein, 393 aa, Chlamydia trachomatis
MKKLLKSVLVFAALSSASSLQALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 2 - protein, 393 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 3 - protein, 395 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMTLNIWDRFDVFCTLGATSGYLKGNSASFNLVGLFGDGVNATKPAADSIPNVQLNQSVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGCGSVAGANTEGQISDTMQIVSLQLNKMKSRKSCGIAVGTTIVDADKYAVTVETRLIDERAAHVNAQFRF

SEQ ID NO: 4 - protein, 395 aa, Chlamydia trachomatis
MKKLLKSVLVFAALSSASSLQALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMALNIWDRFDVFCTLGATSGYLRGNSASFNLVGLFGDSENATQPAATSIPNVQLNQSVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPTIAGCGSVVAANTEGQISDTMQIVSLQLNKMKSRKSCGIAVGTTIVDADKYAVTVETRLIDERAAHVNAQFRF

SEQ ID NO: 5 - protein, 20 aa, Chlamydia trachomatis
AKPTTDTGNSAAPSTLTARE

SEQ ID NO: 6 - protein, 21 aa, Chlamydia trachomatis
DNENQKTVKAESVPNMSFDQS

SEQ ID NO: 7 - protein, 16 aa, Chlamydia trachomatis
KEFPLDLTAGTDAATG

SEQ ID NO: 8 - protein, 29 aa, Chlamydia trachomatis
SATAIFDTTTLNPTIAGAGDVKTGAEGQL

SEQ ID NO: 9 - protein, 20 aa, Chlamydia trachomatis
DKPTSTTGNATAPTTLTARE

SEQ ID NO: 10 - protein, 21 aa, Chlamydia trachomatis
DNENQSTVKTNSVPNMSLDQS

SEQ ID NO: 11 - protein, 16 aa, Chlamydia trachomatis
QEFPLALIAGTDAATG

SEQ ID NO: 12 - protein, 29 aa, Chlamydia trachomatis
SATAIFDTTTLNPTIAGAGDVKASAEGQL

SEQ ID NO: 13 - protein, 21 aa, Chlamydia trachomatis
EALAGASGNTTSTLSKLVERT

SEQ ID NO: 14 - protein, 21 aa, Chlamydia trachomatis
DGVNATKPAADSIPNVQLNQS

SEQ ID NO: 15 - protein, 16 aa, Chlamydia trachomatis
KEFPLDLTAGTDAATG

SEQ ID NO: 16 - protein, 30 aa, Chlamydia trachomatis
LVTPVVDITTLNPTIAGCGSVAGANTEGQI

SEQ ID NO: 17 - protein, 21 aa, Chlamydia trachomatis
EALAGASGNTTSTLSKLVERT

SEQ ID NO: 18 - protein, 21 aa, Chlamydia trachomatis
DSENATQPAATSIPNVQLNQS

SEQ ID NO: 19 - protein, 16 aa, Chlamydia trachomatis
QEFPLALTAGTDAATG

SEQ ID NO: 20 - protein, 30 aa, Chlamydia trachomatis
LAKPVVDITTLNPTIAGCGSVVAANTEGQI

SEQ ID NO: 21 - protein, 388 aa, synthetic construct
MKAKLLVLLCTFTATYALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 22 - protein, 388 aa, synthetic construct
MKAILVVLLYTFATANALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 23 - protein, 388 aa, synthetic construct
MKAKLLVLLCTFTATYALPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSSGIAVGTTIVDADKYAVTVETRLIDERAAHVNAQFRF

SEQ ID NO: 24 - protein, 388 aa, synthetic construct
MKAILVVLLYTFATANALPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSSGIAVGTTIVDADKYAVTVETRLIDERAAHVNAQFRF

SEQ ID NO: 25 - protein, 388 aa, synthetic construct
MKAKLLVLLCTFTATYALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMAFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSCGIAVGTTIVDADKYAVTVETRLIDERAAHVNAQFRF

SEQ ID NO: 26 - protein, 388 aa, synthetic construct
MKAILVVLLYTFATANALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMAFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSCGIAVGTTIVDADKYAVTVETRLIDERAAHVNAQFRF

SEQ ID NO: 27 - protein, 388 aa, synthetic construct
MKAKLLVLLCTFTATYALPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMAFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSSGIAVGTTIVDADKYAVTVETRLIDERAAHVNAQFRF

SEQ ID NO: 28 - protein, 388 aa, synthetic construct
MKAILVVLLYTFATANALPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMAFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSSGIAVGTTIVDADKYAVTVETRLIDERAAHVNAQFRF

SEQ ID NO: 29 - protein, 388 aa, synthetic construct
MKAKLLVLLCTFTATYALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 30 - protein, 388 aa, synthetic construct
MKAILVVLLYTFATANALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 31 - protein, 388 aa, synthetic construct
MKAKLLVLLCTFTATYALPVGNPAEPSLMIDGILWEGFGGDPSDPSTTWSDAISMRMGYYGDFVFDRVLKTDVNKEFQMGDKPTSTTGNATAPTTLTARENPAYGRHMQDAEMFTNAASMALNIWDRFDVFSTLGASSGYLKGNSASFNLVGLFGDNENQSTVKTNSVPNMSLDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSSGIAVGTTIVDADKYAVTVETRLIDERAAHVNAQFRF

SEQ ID NO: 32 - protein, 388 aa, synthetic construct
MKAILVVLLYTFATANALPVGNPAEPSLMIDGILWEGFGGDPSDPSTTWSDAISMRMGYYGDFVFDRVLKTDVNKEFQMGDKPTSTTGNATAPTTLTARENPAYGRHMQDAEMFTNAASMALNIWDRFDVFSTLGASSGYLKGNSASFNLVGLFGDNENQSTVKTNSVPNMSLDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSSGIAVGTTIVDADKYAVTVETRLIDERAAHVNAQFRF

SEQ ID NO: 33 - protein, 388 aa, synthetic construct
MKAKLLVLLCTFTATYALPVGNPAEPSLMIDGILWEGFGGDPCDPCTTWCDAISMRMGYYGDFVFDRVLKTDVNKEFQMGDKPTSTTGAATAPTTLTARENPAYGRHMQDAEMFTNAACMALNIWDRFDVFCTLGASSGYLKGNSASFNLVGLFGDNENQATVKTNSVPNMALDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSCGIAVGTTIVDADKYAVTVETRLIDERAAHVNAQFRF

SEQ ID NO: 34 - protein, 388 aa, synthetic construct
MKAILVVLLYTFATANALPVGNPAEPSLMIDGILWEGFGGDPCDPCTTWCDAISMRMGYYGDFVFDRVLKTDVNKEFQMGDKPTSTTGAATAPTTLTARENPAYGRHMQDAEMFTNAACMALNIWDRFDVFCTLGASSGYLKGNSASFNLVGLFGDNENQATVKTNSVPNMALDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSCGIAVGTTIVDADKYAVTVETRLIDERAAHVNAQFRF

SEQ ID NO: 35 - protein, 388 aa, synthetic construct
MKAKLLVLLCTFTATYALPVGNPAEPSLMIDGILWEGFGGDPSDPSTTWSDAISMRMGYYGDFVFDRVLKTDVNKEFQMGDKPTSTTGAATAPTTLTARENPAYGRHMQDAEMFTNAASMALNIWDRFDVFSTLGASSGYLKGNSASFNLVGLFGDNENQATVKTNSVPNMALDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSSGIAVGTTIVDADKYAVTVETRLIDERAAHVNAQFRF

SEQ ID NO: 36 - protein, 388 aa, synthetic construct
MKAILVVLLYTFATANALPVGNPAEPSLMIDGILWEGFGGDPSDPSTTWSDAISMRMGYYGDFVFDRVLKTDVNKEFQMGDKPTSTTGAATAPTTLTARENPAYGRHMQDAEMFTNAASMALNIWDRFDVFSTLGASSGYLKGNSASFNLVGLFGDNENQATVKTNSVPNMALDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSSGIAVGTTIVDADKYAVTVETRLIDERAAHVNAQFRF

SEQ ID NO: 37 - protein, 390 aa, synthetic construct
MKAKLLVLLCTFTATYALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMTLNIWDRFDVFCTLGATSGYLKGNSASFNLVGLFGDGVNATKPAADSIPNVQLNQSVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGCGSVAGANTEGQISDTMQIVSLQLNKMKSRKSCGIAVGTTIVDADKYAVTVETRLIDERAAHVNAQFRF

SEQ ID NO: 38 - protein, 390 aa, synthetic construct
MKAILVVLLYTFATANALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMTLNIWDRFDVFCTLGATSGYLKGNSASFNLVGLFGDGVNATKPAADSIPNVQLNQSVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGCGSVAGANTEGQISDTMQIVSLQLNKMKSRKSCGIAVGTTIVDADKYAVTVETRLIDERAAHVNAQFRF

SEQ ID NO: 39 - protein, 390 aa, synthetic construct
MKAKLLVLLCTFTATYALPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMTLNIWDRFDVFSTLGATSGYLKGNSASFNLVGLFGDGVNATKPAADSIPNVQLNQSVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGSGSVAGANTEGQISDTMQIVSLQLNKMKSRKSSGIAVGTTIVDADKYAVTVETRLIDERAAHVNAQFRF

SEQ ID NO: 40 - protein, 390 aa, synthetic construct
MKAILVVLLYTFATANALPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMTLNIWDRFDVFSTLGATSGYLKGNSASFNLVGLFGDGVNATKPAADSIPNVQLNQSVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGSGSVAGANTEGQISDTMQIVSLQLNKMKSRKSSGIAVGTTIVDADKYAVTVETRLIDERAAHVNAQFRF

SEQ ID NO: 41 - protein, 390 aa, synthetic construct
MKAKLLVLLCTFTATYALPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMTLNIWDRFDVFCTLGATSGYLKGNSASFNLVGLFGDGVAATKPAADSIPNVQLNQAVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGCGSVAGANTEGQISDTMQIVSLQLNKMKSRKSCGIAVGTTIVDADKYAVTVETRLIDERAAHVNAQFRF

SEQ ID NO: 42 - protein, 390 aa, synthetic construct
MKAILVVLLYTFATANALPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMTLNIWDRFDVFCTLGATSGYLKGNSASFNLVGLFGDGVAATKPAADSIPNVQLNQAVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGCGSVAGANTEGQISDTMQIVSLQLNKMKSRKSCGIAVGTTIVDADKYAVTVETRLIDERAAHVNAQFRF

SEQ ID NO: 43 - protein, 390 aa, synthetic construct
MKAKLLVLLCTFTATYALPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMTLNIWDRFDVFSTLGATSGYLKGNSASFNLVGLFGDGVAATKPAADSIPNVQLNQAVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGSGSVAGANTEGQISDTMQIVSLQLNKMKSRKSSGIAVGTTIVDADKYAVTVETRLIDERAAHVNAQFRF

SEQ ID NO: 44 - protein, 390 aa, synthetic construct
MKAILVVLLYTFATANALPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMTLNIWDRFDVFSTLGATSGYLKGNSASFNLVGLFGDGVAATKPAADSIPNVQLNQAVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGSGSVAGANTEGQISDTMQIVSLQLNKMKSRKSSGIAVGTTIVDADKYAVTVETRLIDERAAHVNAQFRF

SEQ ID NO: 45 - protein, 390 aa, synthetic construct
MKAKLLVLLCTFTATYALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMALNIWDRFDVFCTLGATSGYLRGNSASFNLVGLFGDSENATQPAATSIPNVQLNQSVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPTIAGCGSVVAANTEGQISDTMQIVSLQLNKMKSRKSCGIAVGTTIVDADKYAVTVETRLIDERAAHVNAQFRF

SEQ ID NO: 46 - protein, 390 aa, synthetic construct
MKAILVVLLYTFATANALPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMALNIWDRFDVFCTLGATSGYLRGNSASFNLVGLFGDSENATQPAATSIPNVQLNQSVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPTIAGCGSVVAANTEGQISDTMQIVSLQLNKMKSRKSCGIAVGTTIVDADKYAVTVETRLIDERAAHVNAQFRF

SEQ ID NO: 47 - protein, 390 aa, synthetic construct
MKAKLLVLLCTFTATYALPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMALNIWDRFDVFSTLGATSGYLRGNSASFNLVGLFGDSENATQPAATSIPNVQLNQSVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPTIAGSGSVVAANTEGQISDTMQIVSLQLNKMKSRKSSGIAVGTTIVDADKYAVTVETRLIDERAAHVNAQFRF

SEQ ID NO: 48 - protein, 390 aa, synthetic construct
MKAILVVLLYTFATANALPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMALNIWDRFDVFSTLGATSGYLRGNSASFNLVGLFGDSENATQPAATSIPNVQLNQSVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPTIAGSGSVVAANTEGQISDTMQIVSLQLNKMKSRKSSGIAVGTTIVDADKYAVTVETRLIDERAAHVNAQFRF

SEQ ID NO: 49 - protein, 390 aa, synthetic construct
MKAKLLVLLCTFTATYALPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMALNIWDRFDVFCTLGATSGYLRGNSASFNLVGLFGDSEAATQPAATSIPNVQLNQAVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPAIAGCGSVVAANTEGQISDTMQIVSLQLNKMKSRKSCGIAVGTTIVDADKYAVTVETRLIDERAAHVNAQFRF

SEQ ID NO: 50 - protein, 390 aa, synthetic construct
MKAILVVLLYTFATANALPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMALNIWDRFDVFCTLGATSGYLRGNSASFNLVGLFGDSEAATQPAATSIPNVQLNQAVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPAIAGCGSVVAANTEGQISDTMQIVSLQLNKMKSRKSCGIAVGTTIVDADKYAVTVETRLIDERAAHVNAQFRF

SEQ ID NO: 51 - protein, 390 aa, synthetic construct
MKAKLLVLLCTFTATYALPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMALNIWDRFDVFSTLGATSGYLRGNSASFNLVGLFGDSEAATQPAATSIPNVQLNQAVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPAIAGSGSVVAANTEGQISDTMQIVSLQLNKMKSRKSSGIAVGTTIVDADKYAVTVETRLIDERAAHVNAQFRF

SEQ ID NO: 52 - protein, 390 aa, synthetic construct
MKAILVVLLYTFATANALPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMALNIWDRFDVFSTLGATSGYLRGNSASFNLVGLFGDSEAATQPAATSIPNVQLNQAVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPAIAGSGSVVAANTEGQISDTMQIVSLQLNKMKSRKSSGIAVGTTIVDADKYAVTVETRLIDERAAHVNAQFRF

SEQ ID NO: 53 - protein, 338 aa, synthetic construct
MKAKLLVLLCTFTATYALPVGNPAEPSLMIDGILWEGFGGDPCDPCTTWCDAISMRMGYYGDFVFDRVLKTDVNKEFQMGAASSGGASNPAYGRHMQDAEMFTNAACMALNIWDRFDVFCTLGASSGYLKGNSASFNLVGLFGQPSPQAGPQQVVELYTDTAFSWSVGARAALWECGCATLGASFQYAQSKPKVEELNVLCNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSCGIAVGTTIVDADKYAVTVETRLIDERAAHVNAQFRF

SEQ ID NO: 54 - protein, 338 aa, synthetic construct
MKAILVVLLYTFATANALPVGNPAEPSLMIDGILWEGFGGDPCDPCTTWCDAISMRMGYYGDFVFDRVLKTDVNKEFQMGAASSGGASNPAYGRHMQDAEMFTNAACMALNIWDRFDVFCTLGASSGYLKGNSASFNLVGLFGQPSPQAGPQQVVELYTDTAFSWSVGARAALWECGCATLGASFQYAQSKPKVEELNVLCNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSCGIAVGTTIVDADKYAVTVETRLIDERAAHVNAQFRF

SEQ ID NO: 55 - protein, 338 aa, synthetic construct
MKAKLLVLLCTFTATYALPVGNPAEPSLMIDGILWEGFGGDPSDPSTTWSDAISMRMGYYGDFVFDRVLKTDVNKEFQMGAASSGGASNPAYGRHMQDAEMFTNAASMALNIWDRFDVFSTLGASSGYLKGNSASFNLVGLFGQPSPQAGPQQVVELYTDTAFSWSVGARAALWESGSATLGASFQYAQSKPKVEELNVLSNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSSGIAVGTTIVDADKYAVTVETRLIDERAAHVNAQFRF

SEQ ID NO: 56 - protein, 338 aa, synthetic construct
MKAILVVLLYTFATANALPVGNPAEPSLMIDGILWEGFGGDPSDPSTTWSDAISMRMGYYGDFVFDRVLKTDVNKEFQMGAASSGGASNPAYGRHMQDAEMFTNAASMALNIWDRFDVFSTLGASSGYLKGNSASFNLVGLFGQPSPQAGPQQVVELYTDTAFSWSVGARAALWESGSATLGASFQYAQSKPKVEELNVLSNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSSGIAVGTTIVDADKYAVTVETRLIDERAAHVNAQFRF

SEQ ID NO: 57 - protein, 345 aa, synthetic construct
MKAKLLVLLCTFTATYALPVGNPAEPSLMIDGILWEGFGGDPCDPCTTWCDAISMRMGYYGDFVFDRVLKTDVNKEFQMGSGGAGAPPGAGANPAYGRHMQDAEMFTNAACMALNIWDRFDVFCTLGASSGYLKGNSASFNLVGLFGPQSGAPSGPQPVVELYTDTAFSWSVGARAALWECGCATLGASFQYAQSKPKVEELNVLCNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSCGIAVGTTIVDADKYAVTVETRLIDERAAHVNAQFRF

SEQ ID NO: 58 - protein, 345 aa, synthetic construct
MKAILVVLLYTFATANALPVGNPAEPSLMIDGILWEGFGGDPCDPCTTWCDAISMRMGYYGDFVFDRVLKTDVNKEFQMGSGGAGAPPGAGANPAYGRHMQDAEMFTNAACMALNIWDRFDVFCTLGASSGYLKGNSASFNLVGLFGPQSGAPSGPQPVVELYTDTAFSWSVGARAALWECGCATLGASFQYAQSKPKVEELNVLCNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSCGIAVGTTIVDADKYAVTVETRLIDERAAHVNAQFRF

SEQ ID NO: 59 - protein, 345 aa, synthetic construct
MKAKLLVLLCTFTATYALPVGNPAEPSLMIDGILWEGFGGDPSDPSTTWSDAISMRMGYYGDFVFDRVLKTDVNKEFQMGSGGAGAPPGAGANPAYGRHMQDAEMFTNAASMALNIWDRFDVFSTLGASSGYLKGNSASFNLVGLFGPQSGAPSGPQPVVELYTDTAFSWSVGARAALWESGSATLGASFQYAQSKPKVEELNVLSNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSSGIAVGTTIVDADKYAVTVETRLIDERAAHVNAQFRF

SEQ ID NO: 60 - protein, 345 aa, synthetic construct
MKAILVVLLYTFATANALPVGNPAEPSLMIDGILWEGFGGDPSDPSTTWSDAISMRMGYYGDFVFDRVLKTDVNKEFQMGSGGAGAPPGAGANPAYGRHMQDAEMFTNAASMALNIWDRFDVFSTLGASSGYLKGNSASFNLVGLFGPQSGAPSGPQPVVELYTDTAFSWSVGARAALWESGSATLGASFQYAQSKPKVEELNVLSNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSSGIAVGTTIVDADKYAVTVETRLIDERAAHVNAQFRF

SEQ ID NO: 61 - protein, 409 aa, synthetic construct
MKAKLLVLLCTFTATYAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLN

SEQ ID NO: 62 - protein, 409 aa, synthetic construct
MKAILVVLLYTFATANAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLN

SEQ ID NO: 63 - protein, 409 aa, synthetic construct
MKAKLLVLLCTFTATYAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLN

SEQ ID NO: 64 - protein, 409 aa, synthetic construct
MKAILVVLLYTFATANAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLN

SEQ ID NO: 65 - protein, 438 aa, synthetic construct
MKAKLLVLLCTFTATYAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLNSGSILAIYSTVASSLVLLVSLGAISFGSG

SEQ ID NO: 66 - protein, 438 aa, synthetic construct
MKAILVVLLYTFATANAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLNSGSILAIYSTVASSLVLVVSLGAISFGSG

SEQ ID NO: 67 - protein, 438 aa, synthetic construct
MKAKLLVLLCTFTATYAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLNSGSILAIYSTVASSLVLLVSLGAISFGSG

SEQ ID NO: 68 - protein, 438 aa, synthetic construct
MKAILVVLLYTFATANAISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLNSGSILAIYSTVASSLVLVVSLGAISFGSG

SEQ ID NO: 69 - protein, 381 aa, synthetic construct
MKAKLLVLLCTFTATYAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQ

SEQ ID NO: 70 - protein, 381 aa, synthetic construct
MKAILVVLLYTFATANAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQ

SEQ ID NO: 71 - protein, 381 aa, synthetic construct
MKAKLLVLLCTFTATYAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQ

SEQ ID NO: 72 - protein, 381 aa, synthetic construct
MKAILVVLLYTFATANAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQ

SEQ ID NO: 73 - protein, 410 aa, synthetic construct
MKAKLLVLLCTFTATYAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQSGSILAIYSTVASSLVLLVSLGAISFGSG

SEQ ID NO: 74 - protein, 410 aa, synthetic construct
MKAILVVLLYTFATANAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQSGSILAIYSTVASSLVLVVSLGAISFGSG

SEQ ID NO: 75 - protein, 410 aa, synthetic construct
MKAKLLVLLCTFTATYAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQSGSILAIYSTVASSLVLLVSLGAISFGSG

SEQ ID NO: 76 - protein, 410 aa, synthetic construct
MKAILVVLLYTFATANAISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQSGSILAIYSTVASSLVLVVSLGAISFGSG

SEQ ID NO: 77 - protein, 409 aa, synthetic construct
MKAKLLVLLCTFTATYAISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLN

SEQ ID NO: 78 - protein, 409 aa, synthetic construct
MKAILVVLLYTFATANAISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLN

SEQ ID NO: 79 - protein, 409 aa, synthetic construct
MKAKLLVLLCTFTATYAISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLN

SEQ ID NO: 80 - protein, 409 aa, synthetic construct
MKAILVVLLYTFATANAISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLN

SEQ ID NO: 81 - protein, 438 aa, synthetic construct
MKAKLLVLLCTFTATYAISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLNSGSILAIYSTVASSLVLLVSLGAISFGSG

SEQ ID NO: 82 - protein, 438 aa, synthetic construct
MKAILVVLLYTFATANAISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLNSGSILAIYSTVASSLVLVVSLGAISFGSG

SEQ ID NO: 83 - protein, 438 aa, synthetic construct
MKAKLLVLLCTFTATYAISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLNSGSILAIYSTVASSLVLLVSLGAISFGSG

SEQ ID NO: 84 - protein, 438 aa, synthetic construct
MKAILVVLLYTFATANAISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLNSGSILAIYSTVASSLVLVVSLGAISFGSG

SEQ ID NO: 85 - protein, 381 aa, synthetic construct
MKAKLLVLLCTFTATYAISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQ

SEQ ID NO: 86 - protein, 381 aa, synthetic construct
MKAILVVLLYTFATANAISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQ

SEQ ID NO: 87 - protein, 381 aa, synthetic construct
MKAKLLVLLCTFTATYAISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQ

SEQ ID NO: 88 - protein, 381 aa, synthetic construct
MKAILVVLLYTFATANAISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQ

SEQ ID NO: 89 - protein, 410 aa, synthetic construct
MKAKLLVLLCTFTATYAISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQSGSILAIYSTVASSLVLLVSLGAISFGSG

SEQ ID NO: 90 - protein, 410 aa, synthetic construct
MKAILVVLLYTFATANAISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQSGSILAIYSTVASSLVLVVSLGAISFGSG

SEQ ID NO: 91 - protein, 410 aa, synthetic construct
MKAKLLVLLCTFTATYAISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQSGSILAIYSTVASSLVLLVSLGAISFGSG

SEQ ID NO: 92 - protein, 410 aa, synthetic construct
MKAILVVLLYTFATANAISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQSGSILAIYSTVASSLVLVVSLGAISFGSG

SEQ ID NO: 93 - protein, 291 aa, synthetic construct
MKAKLLVLLCTFTATYANMFTPYIGVKWSRSAFDSDTIRIAQPKSATAIFDTTTLNPTIAGAGDVKTGAEGQLGDTMQIVSLQLNNMFTPYIGVKWSRSAFDSDTIRIAQPKSATAIFDTTTLNPTIAGAGDVKASAEGQLGDTMQIVSLQLNNMFTPYIGVKWSRSAFDSDTIRIAQPRLVTPVVDITTLNPTIAGSGSVAGANTEFQISDTMQIVSLQLNNMFTPYIGVKWSRASFDSNTIRIAQPKLAKPVVDITTLNPTIAGSGSVVAANSEGQISDTMQIVSLQLN

SEQ ID NO: 94 - protein, 320 aa, synthetic construct
MKAKLLVLLCTFTATYANMFTPYIGVKWSRSAFDSDTIRIAQPKSATAIFDTTTLNPTIAGAGDVKTGAEGQLGDTMQIVSLQLNNMFTPYIGVKWSRSAFDSDTIRIAQPKSATAIFDTTTLNPTIAGAGDVKASAEGQLGDTMQIVSLQLNNMFTPYIGVKWSRSAFDSDTIRIAQPRLVTPVVDITTLNPTIAGSGSVAGANTEFQISDTMQIVSLQLNNMFTPYIGVKWSRASFDSNTIRIAQPKLAKPVVDITTLNPTIAGSGSVVAANSEGQISDTMQIVSLQLNSGSILAIYSTVASSLVLLVSLGAISFGSG

SEQ ID NO: 95 - protein, 291 aa, synthetic construct
MKAKLLVLLCTFTATYANMFTPYIGVKWSRSAFDSDTIRIAQPKSATAIFDTTTLNPAIAGAGDVKTGAEGQLGDTMQIVSLQLNNMFTPYIGVKWSRSAFDSDTIRIAQPKSATAIFDTTTLNPAIAGAGDVKASAEGQLGDTMQIVSLQLNNMFTPYIGVKWSRSAFDSDTIRIAQPRLVTPVVDITTLNPAIAGSGSVAGANTEFQISDTMQIVSLQLNNMFTPYIGVKWSRASFDSNTIRIAQPKLAKPVVDITTLNPAIAGSGSVVAANSEGQISDTMQIVSLQLN

SEQ ID NO: 96 - protein, 320 aa, synthetic construct
MKAKLLVLLCTFTATYANMFTPYIGVKWSRSAFDSDTIRIAQPKSATAIFDTTTLNPAIAGAGDVKTGAEGQLGDTMQIVSLQLNNMFTPYIGVKWSRSAFDSDTIRIAQPKSATAIFDTTTLNPAIAGAGDVKASAEGQLGDTMQIVSLQLNNMFTPYIGVKWSRSAFDSDTIRIAQPRLVTPVVDITTLNPAIAGSGSVAGANTEFQISDTMQIVSLQLNNMFTPYIGVKWSRASFDSNTIRIAQPKLAKPVVDITTLNPAIAGSGSVVAANSEGQISDTMQIVSLQLNSGSILAIYSTVASSLVLLVSLGAISFGSG

SEQ ID NO: 97 - protein, 517 aa, synthetic construct
MKAKLLVLLCTFTATYADAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRSAFDSDTIRIAQPKSATAIFDTTTLNPTIAGAGDVKTGAEGQLGDTMQIVSLQLNNMFTPYIGVKWSRSAFDSDTIRIAQPKSATAIFDTTTLNPTIAGAGDVKASAEGQLGDTMQIVSLQLNNMFTPYIGVKWSRSAFDSDTIRIAQPRLVTPVVDITTLNPTIAGSGSVAGANTEFQISDTMQIVSLQLNNMFTPYIGVKWSRASFDSNTIRIAQPKLAKPVVDITTLNPTIAGSGSVVAANSEGQISDTMQIVSLQLN

SEQ ID NO: 98 - protein, 517 aa, synthetic construct
MKAKLLVLLCTFTATYADAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMAFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRSAFDSDTIRIAQPKSATAIFDTTTLNPAIAGAGDVKTGAEGQLGDTMQIVSLQLNNMFTPYIGVKWSRSAFDSDTIRIAQPKSATAIFDTTTLNPAIAGAGDVKASAEGQLGDTMQIVSLQLNNMFTPYIGVKWSRSAFDSDTIRIAQPRLVTPVVDITTLNPAIAGSGSVAGANTEFQISDTMQIVSLQLNNMFTPYIGVKWSRASFDSNTIRIAQPKLAKPVVDITTLNPAIAGSGSVVAANSEGQISDTMQIVSLQLN

SEQ ID NO: 99 - protein, 291 aa, synthetic construct
MKAKLLVLLCTFTATYANMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLN

SEQ ID NO: 100 - protein, 320 aa, synthetic construct
MKAKLLVLLCTFTATYANMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLNSGSILAIYSTVASSLVLLVSLGAISFGSG

SEQ ID NO: 101 - protein, 291 aa, synthetic construct
MKAKLLVLLCTFTATYANMFTPYIGVKWSRASFDADTIRIAQPKSATAIFDTTTLNPAIAGAGDVKTGAEGQLGDTMQIVSLQLNNMFTPYIGVKWSRASFDADTIRIAQPKSATAIFDTTTLNPAIAGAGDVKASAEGQLGDTMQIVSLQLNNMFTPYIGVKWSRASFDSDTIRIAQPRLVTPVVDITTLNPAIAGSGSVAGANTEGQISDTMQIVSLQLNNMFTPYIGVKWSRASFDSNTIRIAQPKLAKPVVDITTLNPAIAGSGSVVAANSEGQISDTMQIVSLQLN

SEQ ID NO: 102 - protein, 320 aa, synthetic construct
MKAKLLVLLCTFTATYANMFTPYIGVKWSRASFDADTIRIAQPKSATAIFDTTTLNPAIAGAGDVKTGAEGQLGDTMQIVSLQLNNMFTPYIGVKWSRASFDADTIRIAQPKSATAIFDTTTLNPAIAGAGDVKASAEGQLGDTMQIVSLQLNNMFTPYIGVKWSRASFDSDTIRIAQPRLVTPVVDITTLNPAIAGSGSVAGANTEGQISDTMQIVSLQLNNMFTPYIGVKWSRASFDSNTIRIAQPKLAKPVVDITTLNPAIAGSGSVVAANSEGQISDTMQIVSLQLNSGSILAIYSTVASSLVLLVSLGAISFGSG

SEQ ID NO: 103 - protein, 517 aa, synthetic construct
MKAKLLVLLCTFTATYADAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLN

SEQ ID NO: 104 - protein, 518 aa, synthetic construct
MKAKLLVLLCTFTATYADAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTNVKAESVPNMAFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNNMFTPYIGVKWSRASFDADTIRIAQPKSATAIFDTTTLNPAIAGAGDVKASAEGQLGDTMQIVSLQLNNMFTPYIGVKWSRASFDSDTIRIAQPRLVTPVVDITTLNPAIAGSGSVAGANTEGQISDTMQIVSLQLNNMFTPYIGVKWSRASFDSNTIRIAQPKLAKPVVDITTLNPAIAGSGSVVAANSEGQISDTMQIVSLQLN

SEQ ID NO: 105 - protein, 533 aa, synthetic construct
MKAKLLVLLCTFTATYAESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 106 - protein, 533 aa, synthetic construct
MKAKLLVLLCTFTATYAESLSTNVISLADTKAKDQTSHKSKKARKQHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTQVSLMLKFSKELQPVSFSGPTKGTITGNTVVFDSLPRLGSKETVEFSVTLKAVSAGDARGEAILSSDTLTVPVSDTENTHIY

SEQ ID NO: 107 - protein, 199 aa, synthetic construct
MKAKLLVLLCTFTATYATTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 108 - protein, 199 aa, synthetic construct
MKAKLLVLLCTFTATYATTKPKTLEIDQNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 109 - protein, 199 aa, synthetic construct
MKAKLLVLLCTFTATYATTKPKTLEIDNNTFLLLEGNLKRIFATPIGYTTFREFQNVVFNSAQGQQELANFLFEMLINGKLLQELPAGQKQSAQSLIVQFMMPIRVAKDIHERGEFINFITSDMLAQQERSVFLNRLSRVDGQEFLLMTDVQNTSHLIRHLLSRLLEAQKNPIGEKNLQEIQEDLDSLRAHFEELTKSV

SEQ ID NO: 110 - protein, 199 aa, synthetic construct
MKAKLLVLLCTFTATYATTKPKTLEIDQNTFLLLEGNLKRIFATPIGYTTFREFQNVVFNSAQGQQELANFLFEMLINGKLLQELPAGQKQSAQSLIVQFMMPIRVAKDIHERGEFINFITSDMLAQQERSVFLNRLSRVDGQEFLLMTDVQNTSHLIRHLLSRLLEAQKNPIGEKNLQEIQEDLDSLRAHFEELTKSV

SEQ ID NO: 111 - protein, 172 aa, synthetic construct
MKAKLLVLLCTFTATYADSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 112 - protein, 172 aa, synthetic construct
MKAKLLVLLCTFTATYADSARPRKSSFGFVPFYSDEEIQQAFVEDFDSKEEQLYKTSAQSTSFRQITFATDSYSIKGEDNLAILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 113 - protein, 969 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 114 - protein, 969 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 115 - protein, 1145 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 116 - protein, 1145 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 117 - protein, 969 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 118 - protein, 969 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 119 - protein, 969 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 120 - protein, 969 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 121 - protein, 969 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 122 - protein, 969 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 123 - protein, 969 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 124 - protein, 969 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 125 - protein, 1145 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 126 - protein, 1145 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 127 - protein, 1145 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 128 - protein, 1145 aa, synthetic construct
MKAKLLVLLCTFTATYASSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 129 - protein, 1145 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 130 - protein, 1145 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 131 - protein, 1145 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 132 - protein, 1145 aa, synthetic construct
MKAKLLVLLCTFTATYASSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 133 - protein, 338 aa, synthetic construct
MLPVGNPAEPSLMIDGILWEGFGGDPCDPCTTWCDAISMRMGYYGDFVFDRVLKTDVNKEFQMGSGGAGAPPGAGANPAYGRHMQDAEMFTNAACMALNIWDRFDVFCTLGASSGYLKGNSASFNLVGLFGPQSGAPSGPQPVVELYTDTAFSWSVGARAALWECGCATLGASFQYAQSKPKVEELNVLCNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSCGIAVGTTIVDADKYAVTVETRLIDERAAHVNAQFRFGGSHHHHHH

SEQ ID NO: 134 - protein, 371 aa, synthetic construct
MPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 135 - protein, 381 aa, synthetic construct
MLPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGGSHHHHHH

SEQ ID NO: 136 - protein, 381 aa, synthetic construct
MLPVGNPAEPSLMIDGILWEGFGGDPSDPSTTWSDAISMRMGYYGDFVFDRVLKTDVNKEFQMGDKPTSTTGNATAPTTLTARENPAYGRHMQDAEMFTNAASMALNIWDRFDVFSTLGASSGYLKGNSASFNLVGLFGDNENQSTVKTNSVPNMSLDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSSGIAVGTTIVDADKYAVTVETRLIDERAAHVNAQFRFGGSHHHHHH

SEQ ID NO: 137-141 - skipped (5 entries)

SEQ ID NO: 142 - protein, 510 aa, synthetic construct
MDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLNGGSHHHHHH

SEQ ID NO: 143 - protein, 526 aa, synthetic construct
MESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIYGGSHHHHHH

SEQ ID NO: 144 - protein, 517 aa, synthetic construct
MLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIYGGSHHHHHH

SEQ ID NO: 145 - protein, 203 aa, synthetic construct
MGSSHHHHHHSSGLVPRGSHMTTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 146 - protein, 176 aa, synthetic construct
MGSSHHHHHHSSGLVPRGSHMDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 147 - protein, 1138 aa, synthetic construct
MSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKAGGSHHHHHH

SEQ ID NO: 148 - protein, 393 aa, synthetic construct; identical to SEQ ID NO: 2

SEQ ID NO: 149 - protein, 402 aa, synthetic construct
MDSKGSSQKGSRLLLLLVVSNLLLPQGVLAMLPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 150 - protein, 402 aa, synthetic construct
MDSKGSSQKGSRLLLLLVVSNLLLPQGVLAMLPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 151 - protein, 393 aa, synthetic construct; identical to SEQ ID NO: 2

SEQ ID NO: 152 - protein, 402 aa, synthetic construct; identical to SEQ ID NO: 149

SEQ ID NO: 153 - protein, 402 aa, synthetic construct; identical to SEQ ID NO: 150

SEQ ID NO: 154 - protein, 393 aa, synthetic construct; identical to SEQ ID NO: 2

SEQ ID NO: 155 - protein, 393 aa, synthetic construct; identical to SEQ ID NO: 2

SEQ ID NO: 156 - protein, 396 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFHHHHHHHHGGSGGSGGSAWSHPQFEK

SEQ ID NO: 157 - protein, 382 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGGGGGGGSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFHHHHHHHHGGSGGSGGSAWSHPQFEK

SEQ ID NO: 158 - protein, 366 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGGGGGGNPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFHHHHHHHHGGSGGSGGSAWSHPQFEK

SEQ ID NO: 159 - protein, 355 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGGGGGGNPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGGGGGGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFHHHHHHHHGGSGGSGGSAWSHPQFEK

SEQ ID NO: 160 - protein, 398 aa, synthetic construct
MLPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFHHHHHHHHGGSGGSGGSAWSHPQFEK

SEQ ID NO: 161 - protein, 407 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGGGGGGNPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 162 - protein, 407 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 163 - protein, 413 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGGGGGGTGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 164 - protein, 398 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGGGGGGTGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 165 - protein, 383 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGGGGGGNPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGGGGGGTGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 166 - protein, 375 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGGGGGGSVVELYTDTAFSWSVGARAALWECGCATLGASFQYAQSKPKVEELNVLCNAAEFTINKPKGYVGGGGGGTGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 167 - protein, 375 aa, synthetic construct
MKKLLKSVLVFAALSSASSLQALPVGNPAEPSLMIDGILWEGFGGDPCDPCTTWCDAISMRMGYYGDFVFDRVLKTDVNKEFQMGGGGGGNPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGGGGGGTGTKDASIDYHEWQASLALSYRLNMFTPYIGVKWSRASFDADTIRIAQPKSGGGGGGDTMQIVSLQLNKMKSRKSCGIAVGTTIVDADKYAVTVETRLIDERAAHVNAQFRFGSSHHHHHHHHGGSGGSGGSAWSHPQFEK

SEQ ID NO: 168 - protein, 1559 aa, synthetic construct
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGSASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTASKLGYEANAGLRLIFGSSHHHHHHHHGGSGGSGGSAWSHPQFEK

SEQ ID NO: 169 - protein, 790 aa, synthetic construct
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQAGSSHHHHHHHHGGSGGSGGSAWSHPQFEK

SEQ ID NO: 170 - protein, 779 aa, synthetic construct
MKAKLLVLLCTFTATYADTICVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQAGSSHHHHHHHHGGSGGSGGSAWSHPQFEK

SEQ ID NO: 171 - protein, 217 aa, synthetic construct
MRKTIFKAFNLLFSLLFLSSCSYPCRDWECHGCDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHARGSSHHHHHHHHGGSGGSGGSAWSHPQFEK

SEQ ID NO: 172 - protein, 217 aa, synthetic construct
MKAKLLVLLCTFTATYADTICSYPCRDWECHGCDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHARGSSHHHHHHHHGGSGGSGGSAWSHPQFEK

SEQ ID NO: 173 - protein, 576 aa, synthetic construct
MNKLIRRAVTIFAVTSVASLFASGVLETSMAESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIYGSSHHHHHHHHGGSGGSGGSAWSHPQFEK

SEQ ID NO: 174 - protein, 565 aa, synthetic construct
MKAKLLVLLCTFTATYADTIESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIYGSSHHHHHHHHGGSGGSGGSAWSHPQFEK

SEQ ID NO: 175 - protein, 212 aa, synthetic construct
MTTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSVGSSHHHHHHHHGGSGGSGGSAWSHPQFEK

SEQ ID NO: 176 - protein, 183 aa, synthetic construct
MTTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 177 - protein, 229 aa, synthetic construct
MKAKLLVLLCTFTATYADTTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSVGSSHHHHHHHHGGSGGSGGSAWSHPQFEK

SEQ ID NO: 178-186 - skipped (9 entries)

SEQ ID NO: 187 - protein, 17 aa, Influenza virus
MKAKLLVLLCTFTATYA

SEQ ID NO: 188 - protein, 17 aa, Influenza virus
MKAILVVLLYTFATANA

SEQ ID NO: 189 - protein, 29 aa, synthetic construct
SGSILAIYSTVASSLVLLVSLGAISFGSG

SEQ ID NO: 190 - protein, 29 aa, synthetic construct
SGSILAIYSTVASSLVLVVSLGAISFGSG

SEQ ID NO: 191 - protein, 31 aa, synthetic construct
MDSKGSSQKGSRLLLLLVVSNLLLPQGVLAM

SEQ ID NO: 192 - protein, 22 aa, synthetic construct
MKKLLKSVLVFAALSSASSLQA

SEQ ID NO: 193 - protein, 16 aa, Influenza virus
MKTIIALSYILCLVFA

SEQ ID NO: 194 - protein, 15 aa, Influenza virus
MKAIIVLLMVVTSNA

SEQ ID NO: 195 - protein, 12 aa, SARS CoV-2
MFVFLVLLPLVS

SEQ ID NO: 196 - protein, 21 aa, SARS CoV-2
MFLLTTKRTMFVFLVLLPLVS

SEQ ID NO: 197 - protein, 1217 aa, synthetic construct
MGSSHHHHHHSSGLVPRGSHMSRVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFD

SEQ ID NO: 198 - protein, 547 aa, synthetic construct
MGSSHHHHHHSSGLVPRGSHMSGVLETSMMAESLSTNVISLADTKAKDNTSHKSKKARKNHSKETPVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINIVNQGTATARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 199-201 - skipped (3 entries)

SEQ ID NO: 202 - RNA, 879 nt, synthetic construct
  source 1..879: mol_type = other RNA
atgaaagccaaactgctggtgctgctgtgcaccttcacagccacctacgccaacatgtttacaccttacatcggggtgaagtggagcagatccgccttcgactcagatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctacaattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaattgatga

SEQ ID NO: 203 - RNA, 966 nt, synthetic construct
  source 1..966: mol_type = other RNA
atgaaggccaagctgctggtgctgctgtgcacctttactgccacatacgccaacatgttcactccatatattggcgtcaaatggtcccggagcgcattcgacagcgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctaccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggctgatga

SEQ ID NO: 204 - RNA, 966 nt, synthetic construct
  source 1..966: mol_type = other RNA
atgaaagccaaactgctggtgctgctgtgcaccttcacagccacctacgccaacatgtttacaccttacatcggggtgaagtggagcagatccgccttcgactcagatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctacaattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggctgatga

SEQ ID NO: 205 - RNA, 879 nt, synthetic construct
  source 1..879: mol_type = other RNA
atgaaggccaagctgctggtgctgctgtgcacctttactgccacatacgccaacatgttcactccatatattggcgtcaaatggtcccggagcgcattcgacagcgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctgccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactgatga

SEQ ID NO: 206 - RNA, 879 nt, synthetic construct
  source 1..879: mol_type = other RNA
atgaaagccaaactgctggtgctgctgtgcaccttcacagccacctacgccaacatgtttacaccttacatcggggtgaagtggagcagatccgccttcgactcagatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctgccattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaattgatga

SEQ ID NO: 207 - RNA, 966 nt, synthetic construct
  source 1..966: mol_type = other RNA
atgaaggccaagctgctggtgctgctgtgcacctttactgccacatacgccaacatgttcactccatatattggcgtcaaatggtcccggagcgcattcgacagcgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctgccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggctgatga

SEQ ID NO: 208 - RNA, 966 nt, synthetic construct
  source 1..966: mol_type = other RNA
atgaaagccaaactgctggtgctgctgtgcaccttcacagccacctacgccaacatgtttacaccttacatcggggtgaagtggagcagatccgccttcgactcagatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctgccattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggctgatga

SEQ ID NO: 209 - RNA, 1557 nt, synthetic construct
  source 1..1557: mol_type = other RNA
atgaaggccaagctgctggtgctgctgtgcacctttactgccacatacgccgacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatgagctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagaagcgcattcgattctgataccattaggattgctcagccaaaaagcgcaaccgccatttttgatactactactctgaatcccacaattgccggcgcaggcgatgtcaagactggggccgagggacagctgggagatacaatgcagatcgtgtccctgcagctgaacaacatgtttacaccatatattggtgtcaagtggagcaggtccgcatttgattccgatactattagaatcgcccagcccaagtccgccacagcaatctttgacactacaaccctgaaccctaccattgctggcgccggggacgtgaaagcatccgccgaagggcagctgggcgatacaatgcagatcgtctccctgcagctcaataacatgttcaccccttacattggggtgaaatggagcagaagtgcttttgatagtgataccattcggattgctcagccccggctcgtcactcccgtggtggatattaccacactgaaccctactattgctgggagcggctctgtggctggcgctaatacggaattccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccaacaattgccggaagcgggtctgtggtcgccgcaaactctgagggacagatctctgacactatgcagattgtgagcctgcagctgaactgatga

SEQ ID NO: 210 - RNA, 1557 nt, synthetic construct
  source 1..1557: mol_type = other RNA
atgaaagccaaactgctggtgctgctgtgcaccttcacagccacctacgccgacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccgtgaaggccgagtccgtccctaatatgtctttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctaggagcgcttttgactctgatacgattagaattgctcagcctaaaagcgccaccgcaattttcgatactactacactgaacccaaccatcgctggagcaggcgatgtgaagaccggcgcagagggacaactgggcgacactatgcagattgtgagtctgcagctcaataacatgttcactccttatattggggtgaaatggtccagatctgcattcgactctgacaccatcagaattgctcagcccaagtctgctacagccatcttcgacaccactaccctgaacccaactattgctggagccggagacgtcaaagcctcagcagaggggcaactgggcgataccatgcagatcgtgtctctgcagctcaacaacatgtttaccccgtatattggcgtgaagtggtcacggtccgcatttgactctgacacaattagaatcgcccagcctagactggtgacacccgttgttgacatcacaacactgaacccaacaatcgccggatctggcagcgtcgccggcgccaatactgagttccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccaaccattgctggaagcgggtccgtggtggccgcaaatagcgagggccagatttctgacaccatgcagattgtgtccctgcagctgaactgatga

SEQ ID NO: 211 - RNA, 1557 nt, synthetic construct
  source 1..1557: mol_type = other RNA
atgaaggccaagctgctggtgctgctgtgcacctttactgccacatacgccgacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatggcctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagaagcgcattcgattctgataccattaggattgctcagccaaaaagcgcaaccgccatttttgatactactactctgaatcccgccattgccggcgcaggcgatgtcaagactggggccgagggacagctgggagatacaatgcagatcgtgtccctgcagctgaacaacatgtttacaccatatattggtgtcaagtggagcaggtccgcatttgattccgatactattagaatcgcccagcccaagtccgccacagcaatctttgacactacaaccctgaaccctgccattgctggcgccggggacgtgaaagcatccgccgaagggcagctgggcgatacaatgcagatcgtctccctgcagctcaataacatgttcaccccttacattggggtgaaatggagcagaagtgcttttgatagtgataccattcggattgctcagccccggctcgtcactcccgtggtggatattaccacactgaaccctgccattgctgggagcggctctgtggctggcgctaatacggaattccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccagccattgccggaagcgggtctgtggtcgccgcaaactctgagggacagatctctgacactatgcagattgtgagcctgcagctgaactgatga

SEQ ID NO: 212 - RNA, 1557 nt, synthetic construct; identical to SEQ ID NO: 211
  source 1..1557: mol_type = other RNA

SEQ ID NO: 213 - RNA, 1020 nt, synthetic construct
  source 1..1020: mol_type = other RNA
atgaaggccaagctgctggtgctgctgtgcacctttactgccacatacgccctgcctgtgggcaatcctgctgaaccttctctgatgattgacggaatcctgtgggaaggctttggcggggacccttgcgacccttgtaccacttggtgcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgcttgcatggccctgaacatttgggacagattcgacgtgttttgcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagtgcggatgtgccacactgggcgcctctttccagtatgcacagtctaagcctaaggtggaggagctgaatgtgctgtgcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtcctgtggaatcgccgtgggaaccactatcgtggacgcagacaagtatgctgtgaccgtggagacacgcctgattgatgaacgcgcagcccatgtgaatgcacagttccggttttgatga

SEQ ID NO: 214 - RNA, 1020 nt, synthetic construct
  source 1..1020: mol_type = other RNA
atgaaagccaaactgctggtgctgctgtgcaccttcacagccacctacgccctgcctgtggggaatcccgctgagccatctctgatgatcgatgggattctgtgggagggcttcggcggggacccatgcgatccatgtacaacttggtgcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgcctgcatggccctcaacatctgggacaggtttgacgtgttctgcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaatgtggatgcgctactctgggcgctagcttccagtacgcacaaagcaaaccaaaagtcgaggagctgaacgtgctgtgcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatcttgtgggatcgccgtgggaaccacaattgtggacgctgacaaatacgctgtgacagttgaaacccgcctgatcgatgaaagagctgctcacgtgaatgcacagtttaggttttgatga

SEQ ID NO: 215 - RNA, 1020 nt, synthetic construct
  source 1..1020: mol_type = other RNA
atgaaggctatcctggtggtgctgctgtatacttttgccaccgccaatgccctgcctgtgggcaatcctgctgaaccttctctgatgattgacggaatcctgtgggaaggctttggcggggacccttgcgacccttgtaccacttggtgcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgcttgcatggccctgaacatttgggacagattcgacgtgttttgcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagtgcggatgtgccacactgggcgcctctttccagtatgcacagtctaagcctaaggtggaggagctgaatgtgctgtgcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtcctgtggaatcgccgtgggaaccactatcgtggacgcagacaagtatgctgtgaccgtggagacacgcctgattgatgaacgcgcagcccatgtgaatgcacagttccggttttgatga

SEQ ID NO: 216 - RNA, 1020 nt, synthetic construct
  source 1..1020: mol_type = other RNA
atgaaggccattctggtggtgctgctgtataccttcgccacagccaatgcactgcctgtggggaatcccgctgagccatctctgatgatcgatgggattctgtgggagggcttcggcggggacccatgcgatccatgtacaacttggtgcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgcctgcatggccctcaacatctgggacaggtttgacgtgttctgcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaatgtggatgcgctactctgggcgctagcttccagtacgcacaaagcaaaccaaaagtcgaggagctgaacgtgctgtgcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatcttgtgggatcgccgtgggaaccacaattgtggacgctgacaaatacgctgtgacagttgaaacccgcctgatcgatgaaagagctgctcacgtgaatgcacagtttaggttttgatga

SEQ ID NO: 217 - RNA, 1020 nt, synthetic construct
  source 1..1020: mol_type = other RNA
atgaaggccaagctgctggtgctgctgtgcacctttactgccacatacgccctgcctgtgggcaatcctgctgaaccttctctgatgattgacggaatcctgtgggaaggctttggcggggaccctagcgaccctagcaccacttggagcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgctagcatggccctgaacatttgggacagattcgacgtgtttagcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagagcggaagcgccacactgggcgcctctttccagtatgcacagtctaagcctaaggtggaggagctgaatgtgctgagcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtccagcggaatcgccgtgggaaccactatcgtggacgcagacaagtatgctgtgaccgtggagacacgcctgattgatgaacgcgcagcccatgtgaatgcacagttccggttttgatga

SEQ ID NO: 218 - RNA, 1020 nt, synthetic construct
  source 1..1020: mol_type = other RNA
atgaaagccaaactgctggtgctgctgtgcaccttcacagccacctacgccctgcctgtggggaatcccgctgagccatctctgatgatcgatgggattctgtgggagggcttcggcggggacccaagcgatccaagcacaacttggagcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgccagcatggccctcaacatctgggacaggtttgacgtgttcagcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaaagcggaagcgctactctgggcgctagcttccagtacgcacaaagcaaaccaaaagtcgaggagctgaacgtgctgagcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatctagcgggatcgccgtgggaaccacaattgtggacgctgacaaatacgctgtgacagttgaaacccgcctgatcgatgaaagagctgctcacgtgaatgcacagtttaggttttgatga

SEQ ID NO: 219 - RNA, 1020 nt, synthetic construct
  source 1..1020: mol_type = other RNA
atgaaggctatcctggtggtgctgctgtatacttttgccaccgccaatgccctgcctgtgggcaatcctgctgaaccttctctgatgattgacggaatcctgtgggaaggctttggcggggaccctagcgaccctagcaccacttggagcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgctagcatggccctgaacatttgggacagattcgacgtgtttagcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagagcggaagcgccacactgggcgcctctttccagtatgcacagtctaagcctaaggtggaggagctgaatgtgctgagcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtccagcggaatcgccgtgggaaccactatcgtggacgcagacaagtatgctgtgaccgtggagacacgcctgattgatgaacgcgcagcccatgtgaatgcacagttccggttttgatga

SEQ ID NO: 220 - RNA, 1020 nt, synthetic construct
  source 1..1020: mol_type = other RNA
atgaaggccattctggtggtgctgctgtataccttcgccacagccaatgcactgcctgtggggaatcccgctgagccatctctgatgatcgatgggattctgtgggagggcttcggcggggacccaagcgatccaagcacaacttggagcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgccagcatggccctcaacatctgggacaggtttgacgtgttcagcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaaagcggaagcgctactctgggcgctagcttccagtacgcacaaagcaaaccaaaagtcgaggagctgaacgtgctgagcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatctagcgggatcgccgtgggaaccacaattgtggacgctgacaaatacgctgtgacagttgaaacccgcctgatcgatgaaagagctgctcacgtgaatgcacagtttaggttttgatga

SEQ ID NO: 221 - RNA, 1041 nt, synthetic construct
  source 1..1041: mol_type = other RNA
atgaaggccaagctgctggtgctgctgtgcacctttactgccacatacgccctgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 222 - RNA, 1041 nt, synthetic construct
  source 1..1041: mol_type = other RNA
atgaaagccaaactgctggtgctgctgtgcaccttcacagccacctacgccctgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 223 - RNA, 1041 nt, synthetic construct
  source 1..1041: mol_type = other RNA
atgaaggctatcctggtggtgctgctgtatacttttgccaccgccaatgccctgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 224 - RNA, 1041 nt, synthetic construct
  source 1..1041: mol_type = other RNA
atgaaggccattctggtggtgctgctgtataccttcgccacagccaatgcactgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 225 - RNA, 1041 nt, synthetic construct
  source 1..1041: mol_type = other RNA
atgaaggccaagctgctggtgctgctgtgcacctttactgccacatacgccctgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 226 - RNA, 1041 nt, synthetic construct
  source 1..1041: mol_type = other RNA
atgaaagccaaactgctggtgctgctgtgcaccttcacagccacctacgccctgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 227 - RNA, 1041 nt, synthetic construct
  source 1..1041: mol_type = other RNA
atgaaggctatcctggtggtgctgctgtatacttttgccaccgccaatgccctgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 228 - RNA, 1041 nt, synthetic construct
  source 1..1041: mol_type = other RNA
atgaaggccattctggtggtgctgctgtataccttcgccacagccaatgcactgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 229 - RNA, 1233 nt, synthetic construct
  source 1..1233: mol_type = other RNA
atgaaggccaagctgctggtgctgctgtgcacctttactgccacatacgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactgatga

SEQ ID NO: 230-231 - skipped (2 entries)

SEQ ID NO: 232 - RNA, 1233 nt, synthetic construct
  source 1..1233: mol_type = other RNA
atgaaagccaaactgctggtgctgctgtgcaccttcacagccacctacgccatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaactgatga

SEQ ID NO: 233 - RNA, 1320 nt, synthetic construct
  source 1..1320: mol_type = other RNA
atgaaggccaagctgctggtgctgctgtgcacctttactgccacatacgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactccggctccatcctggccatctatagcaccgtggctagcagcctggtgctgctggtgtccctgggagctattagcttcggatctggctgatga

SEQ ID NO: 234 - RNA, 1320 nt, synthetic construct
  source 1..1320: mol_type = other RNA
atgaaagccaaactgctggtgctgctgtgcaccttcacagccacctacgccatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaacagcggctctattctggccatctacagtactgtggcttcctccctggtgctgctggtgtctctgggcgccatttccttcggctctggctgatga

SEQ ID NO: 235 - RNA, 1320 nt, synthetic construct
  source 1..1320: mol_type = other RNA
atgaaggccaagctgctggtgctgctgtgcacctttactgccacatacgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactccggctccatcctggccatctatagcaccgtggctagcagcctggtgctgctggtgtccctgggagctattagcttcggatctggctgatga

SEQ ID NO: 236 - skipped

SEQ ID NO: 237 - RNA, 1233 nt, synthetic construct
  source 1..1233: mol_type = other RNA
atgaaggctatcctggtggtgctgctgtatacttttgccaccgccaatgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactgatga

SEQ ID NO: 238 - RNA, 1233 nt, synthetic construct
  source 1..1233: mol_type = other RNA
atgaaggccattctggtggtgctgctgtataccttcgccacagccaatgcaatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaactgatga

SEQ ID NO: 239 - RNA, 1233 nt, synthetic construct
  source 1..1233: mol_type = other RNA
atgaaggctatcctggtggtgctgctgtatacttttgccaccgccaatgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactgatga

SEQ ID NO: 240 - RNA, 1233 nt, synthetic construct
  source 1..1233: mol_type = other RNA
atgaaggccattctggtggtgctgctgtataccttcgccacagccaatgcaatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaactgatga

SEQ ID NO: 241 - RNA, 1320 nt, synthetic construct
  source 1..1320: mol_type = other RNA
atgaaggctatcctggtggtgctgctgtatacttttgccaccgccaatgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactccggctccatcctggccatctatagcaccgtggctagcagcctggtgctggtggtgtccctgggagctattagcttcggatctggctgatga

SEQ ID NO: 242 - RNA, 1320 nt, synthetic construct
  source 1..1320: mol_type = other RNA
atgaaggccattctggtggtgctgctgtataccttcgccacagccaatgcaatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaacagcggctctattctggccatctacagtactgtggcttcctccctggtgctggtggtgtctctgggcgccatttccttcggctctggctgatga

SEQ ID NO: 243 - RNA, 1320 nt, synthetic construct
  source 1..1320: mol_type = other RNA
atgaaggctatcctggtggtgctgctgtatacttttgccaccgccaatgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactccggctccatcctggccatctatagcaccgtggctagcagcctggtgctggtggtgtccctgggagctattagcttcggatctggctgatga

SEQ ID NO: 244 - RNA, 1320 nt, synthetic construct
  source 1..1320: mol_type = other RNA
atgaaggccattctggtggtgctgctgtataccttcgccacagccaatgcaatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaacagcggctctattctggccatctacagtactgtggcttcctccctggtgctggtggtgtctctgggcgccatttccttcggctctggctgatga

SEQ ID NO: 245 - RNA, 1149 nt, synthetic construct
  source 1..1149: mol_type = other RNA
atgaaggccaagctgctggtgctgctgtgcacctttactgccacatacgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtgatga

SEQ ID NO: 246-247 - skipped (2 entries)

SEQ ID NO: 248 - RNA, 1149 nt, synthetic construct
  source 1..1149: mol_type = other RNA
atgaaagccaaactgctggtgctgctgtgcaccttcacagccacctacgccatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagtgatga

SEQ ID NO: 249 - RNA, 1236 nt, synthetic construct
  source 1..1236: mol_type = other RNA
atgaaggccaagctgctggtgctgctgtgcacctttactgccacatacgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtccggctccatcctggccatctatagcaccgtggctagcagcctggtgctgctggtgtccctgggagctattagcttcggatctggctgatga

SEQ ID NO: 250 - RNA, 1236 nt, synthetic construct
  source 1..1236: mol_type = other RNA
atgaaagccaaactgctggtgctgctgtgcaccttcacagccacctacgccatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagagcggctctattctggccatctacagtactgtggcttcctccctggtgctgctggtgtctctgggcgccatttccttcggctctggctgatga

SEQ ID NO: 251 - RNA, 1236 nt, synthetic construct
  source 1..1236: mol_type = other RNA
atgaaggccaagctgctggtgctgctgtgcacctttactgccacatacgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtccggctccatcctggccatctatagcaccgtggctagcagcctggtgctgctggtgtccctgggagctattagcttcggatctggctgatga

SEQ ID NO: 252 - skipped

SEQ ID NO: 253 - RNA, 1149 nt, synthetic construct
  source 1..1149: mol_type = other RNA
atgaaggctatcctggtggtgctgctgtatacttttgccaccgccaatgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtgatga

SEQ ID NO: 254 - RNA, 1149 nt, synthetic construct
  source 1..1149: mol_type = other RNA
atgaaggccattctggtggtgctgctgtataccttcgccacagccaatgcaatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagtgatga

SEQ ID NO: 255 - RNA, 1149 nt, synthetic construct
  source 1..1149: mol_type = other RNA
atgaaggctatcctggtggtgctgctgtatacttttgccaccgccaatgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtgatga

SEQ ID NO: 256 - RNA, 1149 nt, synthetic construct
  source 1..1149: mol_type = other RNA
atgaaggccattctggtggtgctgctgtataccttcgccacagccaatgcaatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagtgatga

SEQ ID NO: 257 - RNA, 1236 nt, synthetic construct
  source 1..1236: mol_type = other RNA
atgaaggctatcctggtggtgctgctgtatacttttgccaccgccaatgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtccggctccatcctggccatctatagcaccgtggctagcagcctggtgctggtggtgtccctgggagctattagcttcggatctggctgatga

SEQ ID NO: 258 - RNA, 1236 nt, synthetic construct
  source 1..1236: mol_type = other RNA
atgaaggccattctggtggtgctgctgtataccttcgccacagccaatgcaatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagagcggctctattctggccatctacagtactgtggcttcctccctggtgctggtggtgtctctgggcgccatttccttcggctctggctgatga

SEQ ID NO: 259 - RNA, 1236 nt, synthetic construct
  source 1..1236: mol_type = other RNA
atgaaggctatcctggtggtgctgctgtatacttttgccaccgccaatgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtccggctccatcctggccatctatagcaccgtggctagcagcctggtgctggtggtgtccctgggagctattagcttcggatctggctgatga

SEQ ID NO: 260 - RNA, 1236 nt, synthetic construct
  source 1..1236: mol_type = other RNA
atgaaggccattctggtggtgctgctgtataccttcgccacagccaatgcaatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagagcggctctattctggccatctacagtactgtggcttcctccctggtgctggtggtgtctctgggcgccatttccttcggctctggctgatga

SEQ ID NO: 261 - RNA, 1233 nt, synthetic construct
  source 1..1233: mol_type = other RNA
atgaaggccaagctgctggtgctgctgtgcacctttactgccacatacgccatttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactgatga

SEQ ID NO: 262 - RNA, 1233 nt, synthetic construct
  source 1..1233: mol_type = other RNA
atgaaagccaaactgctggtgctgctgtgcaccttcacagccacctacgccatttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaattgatga

SEQ ID NO: 263 - skipped

SEQ ID NO: 264 - RNA, 1233 nt, synthetic construct
  source 1..1233: mol_type = other RNA
atgaaagccaaactgctggtgctgctgtgcaccttcacagccacctacgccatttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaattgatga

SEQ ID NO: 265 - RNA, 1320 nt, synthetic construct
  source 1..1320: mol_type = other RNA
atgaaggccaagctgctggtgctgctgtgcacctttactgccacatacgccatttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactccggctccatcctggccatctatagcaccgtggctagcagcctggtgctgctggtgtccctgggagctattagcttcggatctggctgataa

SEQ ID NO: 266 - RNA, 1320 nt, synthetic construct
  source 1..1320: mol_type = other RNA
atgaaagccaaactgctggtgctgctgtgcaccttcacagccacctacgccatttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaatagcggctctattctggccatctacagtactgtggcttcctccctggtgctgctggtgtctctgggcgccatttccttcggctctggctgatga

SEQ ID NO: 267 - skipped

SEQ ID NO: 268 - RNA, 1320 nt, synthetic construct
  source 1..1320: mol_type = other RNA
atgaaagccaaactgctggtgctgctgtgcaccttcacagccacctacgccatttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaatagcggctctattctggccatctacagtactgtggcttcctccctggtgctgctggtgtctctgggcgccatttccttcggctctggctgatga

SEQ ID NO: 269 - RNA, 1233 nt, synthetic construct
  source 1..1233: mol_type = other RNA
atgaaggctatcctggtggtgctgctgtatacttttgccaccgccaatgccatttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactgatga

SEQ ID NO: 270 - RNA, 1233 nt, synthetic construct
  source 1..1233: mol_type = other RNA
atgaaggccattctggtggtgctgctgtataccttcgccacagccaatgcaatttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaattgatga

SEQ ID NO: 271 - skipped

SEQ ID NO: 272 - RNA, 1233 nt, synthetic construct
  source 1..1233: mol_type = other RNA
atgaaggccattctggtggtgctgctgtataccttcgccacagccaatgcaatttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaattgatga

SEQ ID NO: 273 - RNA, 1320 nt, synthetic construct
  source 1..1320: mol_type = other RNA
atgaaggctatcctggtggtgctgctgtatacttttgccaccgccaatgccatttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactccggctccatcctggccatctatagcaccgtggctagcagcctggtgctggtggtgtccctgggagctattagcttcggatctggctgatga

SEQ ID NO: 274 - RNA, 1320 nt, synthetic construct
  source 1..1320: mol_type = other RNA
atgaaggccattctggtggtgctgctgtataccttcgccacagccaatgcaatttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaatagcggctctattctggccatctacagtactgtggcttcctccctggtgctggtggtgtctctgggcgccatttccttcggctctggctgatga

SEQ ID NO: 275 - skipped

SEQ ID NO: 276 - RNA, 1320 nt, synthetic construct
  source 1..1320: mol_type = other RNA
atgaaggccattctggtggtgctgctgtataccttcgccacagccaatgcaatttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaatagcggctctattctggccatctacagtactgtggcttcctccctggtgctggtggtgtctctgggcgccatttccttcggctctggctgatga

SEQ ID NO: 277 - RNA, 1149 nt, synthetic construct
  source 1..1149: mol_type = other RNA
atgaaggccaagctgctggtgctgctgtgcacctttactgccacatacgccatttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtgatga

SEQ ID NO: 278 - RNA, 1149 nt, synthetic construct
  source 1..1149: mol_type = other RNA
atgaaagccaaactgctggtgctgctgtgcaccttcacagccacctacgccatctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagtgatga

SEQ ID NO: 279 - skipped

SEQ ID NO: 280 - RNA, 1149 nt, synthetic construct
  source 1..1149: mol_type = other RNA
atgaaagccaaactgctggtgctgctgtgcaccttcacagccacctacgccatctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagtgatga

SEQ ID NO: 281 - skipped

SEQ ID NO: 282 - RNA, 1236 nt, synthetic construct
  source 1..1236: mol_type = other RNA
atgaaagccaaactgctggtgctgctgtgcaccttcacagccacctacgccatctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagagcggctctattctggccatctacagtactgtggcttcctccctggtgctgctggtgtctctgggcgccatttccttcggctctggctgatga

SEQ ID NO: 283 - RNA, 1236 nt, synthetic construct
  source 1..1236: mol_type = other RNA
atgaaggccaagctgctggtgctgctgtgcacctttactgccacatacgccatttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtccggctccatcctggccatctatagcaccgtggctagcagcctggtgctgctggtgtccctgggagctattagcttcggatctggctgatga

SEQ ID NO: 284 - RNA, 1236 nt, synthetic construct
  source 1..1236: mol_type = other RNA
atgaaagccaaactgctggtgctgctgtgcaccttcacagccacctacgccatctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagagcggctctattctggccatctacagtactgtggcttcctccctggtgctgctggtgtctctgggcgccatttccttcggctctggctgatga

SEQ ID NO: 285 - RNA, 1149 nt, synthetic construct
  source 1..1149: mol_type = other RNA
atgaaggctatcctggtggtgctgctgtatacttttgccaccgccaatgccatttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtgatga

SEQ ID NO: 286 - RNA, 1149 nt, synthetic construct
  source 1..1149: mol_type = other RNA
atgaaggccattctggtggtgctgctgtataccttcgccacagccaatgcaatctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagtgatga

SEQ ID NO: 287 - RNA, 1149 nt, synthetic construct
  source 1..1149: mol_type = other RNA
atgaaggctatcctggtggtgctgctgtatacttttgccaccgccaatgccatttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtgatga

SEQ ID NO: 288 - RNA, 1149 nt, synthetic construct
  source 1..1149: mol_type = other RNA
atgaaggccattctggtggtgctgctgtataccttcgccacagccaatgcaatctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagtgatga

SEQ ID NO: 289 - RNA, 1237 nt, synthetic construct
  source 1..1237: mol_type = other RNA
atgaaggctatcctggtggtgctgctgtatacttttgccaccgccaatgccatttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtccggctccatcctggccatctatagcaccgtggctagcagcctggtgctggtggtgtccctgggagctattagcttcggatctggctgatgat

SEQ ID NO: 290 - RNA, 1236 nt, synthetic construct
  source 1..1236: mol_type = other RNA
atgaaggccattctggtggtgctgctgtataccttcgccacagccaatgcaatctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagagcggctctattctggccatctacagtactgtggcttcctccctggtgctggtggtgtctctgggcgccatttccttcggctctggctgatga

SEQ ID NO: 291 - RNA, 1236 nt, synthetic construct
  source 1..1236: mol_type = other RNA
atgaaggctatcctggtggtgctgctgtatacttttgccaccgccaatgccatttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtccggctccatcctggccatctatagcaccgtggctagcagcctggtgctggtggtgtccctgggagctattagcttcggatctggctgatga

SEQ ID NO: 292 - RNA, 1236 nt, synthetic construct
  source 1..1236: mol_type = other RNA
atgaaggccattctggtggtgctgctgtataccttcgccacagccaatgcaatctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagagcggctctattctggccatctacagtactgtggcttcctccctggtgctggtggtgtctctgggcgccatttccttcggctctggctgatga

SEQ ID NO: 293 - skipped

SEQ ID NO: 294 - RNA, 1170 nt, synthetic construct
  source 1..1170: mol_type = other RNA
atgaaagccaaactgctggtgctgctgtgcaccttcacagccacctacgccctgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 295 - RNA, 1170 nt, synthetic construct
  source 1..1170: mol_type = other RNA
atgaaggccaagctgctggtgctgctgtgcacctttactgccacatacgccctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 296 - RNA, 1170 nt, synthetic construct
  source 1..1170: mol_type = other RNA
atgaaagccaaactgctggtgctgctgtgcaccttcacagccacctacgccctgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 297 - RNA, 1170 nt, synthetic construct
  source 1..1170: mol_type = other RNA
atgaaggccaagctgctggtgctgctgtgcacctttactgccacatacgccctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 298 - RNA, 1170 nt, synthetic construct
  source 1..1170: mol_type = other RNA
atgaaagccaaactgctggtgctgctgtgcaccttcacagccacctacgccctgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 299 - skipped

SEQ ID NO: 300 - RNA, 1170 nt, synthetic construct
  source 1..1170: mol_type = other RNA
atgaaagccaaactgctggtgctgctgtgcaccttcacagccacctacgccctgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 301 - RNA, 1170 nt, synthetic construct
  source 1..1170: mol_type = other RNA
atgaaggctatcctggtggtgctgctgtatacttttgccaccgccaatgccctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 302 - RNA, 1170 nt, synthetic construct
  source 1..1170: mol_type = other RNA
atgaaggccattctggtggtgctgctgtataccttcgccacagccaatgcactgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 303 - RNA, 1170 nt, synthetic construct
  source 1..1170: mol_type = other RNA
atgaaggctatcctggtggtgctgctgtatacttttgccaccgccaatgccctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 304 - RNA, 1170 nt, synthetic construct
  source 1..1170: mol_type = other RNA
atgaaggccattctggtggtgctgctgtataccttcgccacagccaatgcactgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 305 - RNA, 1170 nt, synthetic construct
  source 1..1170: mol_type = other RNA
atgaaggctatcctggtggtgctgctgtatacttttgccaccgccaatgccctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 306 - RNA, 1170 nt, synthetic construct
  source 1..1170: mol_type = other RNA
atgaaggccattctggtggtgctgctgtataccttcgccacagccaatgcactgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 307 - RNA, 1170 nt, synthetic construct
  source 1..1170: mol_type = other RNA
atgaaggctatcctggtggtgctgctgtatacttttgccaccgccaatgccctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 308 - RNA, 1170 nt, synthetic construct
  source 1..1170: mol_type = other RNA
atgaaggccattctggtggtgctgctgtataccttcgccacagccaatgcactgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 309 - RNA, 1170 nt, synthetic construct
  source 1..1170: mol_type = other RNA
atgaaggccaagctgctggtgctgctgtgcacctttactgccacatacgccctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 310 - skipped

SEQ ID NO: 311 - RNA, 1170 nt, synthetic construct
  source 1..1170: mol_type = other RNA
atgaaggccaagctgctggtgctgctgtgcacctttactgccacatacgccctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 312 - RNA, 1170 nt, synthetic construct
  source 1..1170: mol_type = other RNA
atgaaagccaaactgctggtgctgctgtgcaccttcacagccacctacgccctgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 313 - RNA, 1170 nt, synthetic construct
  source 1..1170: mol_type = other RNA
atgaaggccaagctgctggtgctgctgtgcacctttactgccacatacgccctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 314 - RNA, 1167 nt, synthetic construct
  source 1..1167: mol_type = other RNA
atgaaagccaaactgctggtgctgctgtgcaccttcacagccacctacgccctgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctga

SEQ ID NO: 315 - skipped

SEQ ID NO: 316 - RNA, 1170 nt, synthetic construct
  source 1..1170: mol_type = other RNA
atgaaagccaaactgctggtgctgctgtgcaccttcacagccacctacgccctgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 317 - RNA, 1170 nt, synthetic construct
  source 1..1170: mol_type = other RNA
atgaaggctatcctggtggtgctgctgtatacttttgccaccgccaatgccctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 318 - RNA, 1170 nt, synthetic construct
  source 1..1170: mol_type = other RNA
atgaaggccattctggtggtgctgctgtataccttcgccacagccaatgcactgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctgatga

SEQ ID NO: 319 - RNA, 1170 nt, synthetic construct
  source 1..1170: mol_type = other RNA
atgaaggctatcctggtggtgctgctgtatacttttgccaccgccaatgccctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 320 - RNA, 1170 nt, synthetic construct
  source 1..1170: mol_type = other RNA
atgaaggccattctggtggtgctgctgtataccttcgccacagccaatgcactgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 321 - RNA, 1170 nt, synthetic construct
  source 1..1170: mol_type = other RNA
atgaaggctatcctggtggtgctgctgtatacttttgccaccgccaatgccctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 322 - RNA, 1170 nt, synthetic construct
  source 1..1170: mol_type = other RNA
atgaaggccattctggtggtgctgctgtataccttcgccacagccaatgcactgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctgatga

SEQ ID NO: 323 - RNA, 1170 nt, synthetic construct
  source 1..1170: mol_type = other RNA
atgaaggctatcctggtggtgctgctgtatacttttgccaccgccaatgccctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 324 - RNA, 1170 nt, synthetic construct
  source 1..1170: mol_type = other RNA
atgaaggccattctggtggtgctgctgtataccttcgccacagccaatgcactgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 325 - skipped

SEQ ID NO: 326 - RNA, 1176 nt, synthetic construct
  source 1..1176: mol_type = other RNA
atgaaagccaaactgctggtgctgctgtgcaccttcacagccacctacgccctgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 327 - RNA, 1176 nt, synthetic construct
  source 1..1176: mol_type = other RNA
atgaaggccaagctgctggtgctgctgtgcacctttactgccacatacgccctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 328 - RNA, 1176 nt, synthetic construct
  source 1..1176: mol_type = other RNA
atgaaagccaaactgctggtgctgctgtgcaccttcacagccacctacgccctgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 329 - RNA, 1176 nt, synthetic construct
  source 1..1176: mol_type = other RNA
atgaaggccaagctgctggtgctgctgtgcacctttactgccacatacgccctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 330 - RNA, 1176 nt, synthetic construct
  source 1..1176: mol_type = other RNA
atgaaagccaaactgctggtgctgctgtgcaccttcacagccacctacgccctgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 331 - RNA, 1176 nt, synthetic construct
  source 1..1176: mol_type = other RNA
atgaaggccaagctgctggtgctgctgtgcacctttactgccacatacgccctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 332 - RNA, 1176 nt, synthetic construct
  source 1..1176: mol_type = other RNA
atgaaagccaaactgctggtgctgctgtgcaccttcacagccacctacgccctgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 333 - RNA, 1176 nt, synthetic construct
  source 1..1176: mol_type = other RNA
atgaaggctatcctggtggtgctgctgtatacttttgccaccgccaatgccctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 334 - RNA, 1176 nt, synthetic construct
  source 1..1176: mol_type = other RNA
atgaaggccattctggtggtgctgctgtataccttcgccacagccaatgcactgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 335 - RNA, 1176 nt, synthetic construct
  source 1..1176: mol_type = other RNA
atgaaggctatcctggtggtgctgctgtatacttttgccaccgccaatgccctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 336 - RNA, 1176 nt, synthetic construct
  source 1..1176: mol_type = other RNA
atgaaggccattctggtggtgctgctgtataccttcgccacagccaatgcactgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 337 - RNA, 1176 nt, synthetic construct
  source 1..1176: mol_type = other RNA
atgaaggctatcctggtggtgctgctgtatacttttgccaccgccaatgccctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 338 - RNA, 1176 nt, synthetic construct
  source 1..1176: mol_type = other RNA
atgaaggccattctggtggtgctgctgtataccttcgccacagccaatgcactgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 339 - RNA, 1176 nt, synthetic construct
  source 1..1176: mol_type = other RNA
atgaaggctatcctggtggtgctgctgtatacttttgccaccgccaatgccctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 340 - RNA, 1176 nt, synthetic construct
  source 1..1176: mol_type = other RNA
atgaaggccattctggtggtgctgctgtataccttcgccacagccaatgcactgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 341 - skipped

SEQ ID NO: 342 - RNA, 1176 nt, synthetic construct
  source 1..1176: mol_type = other RNA
atgaaagccaaactgctggtgctgctgtgcaccttcacagccacctacgccctgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 343 - RNA, 1176 nt, synthetic construct
  source 1..1176: mol_type = other RNA
atgaaggccaagctgctggtgctgctgtgcacctttactgccacatacgccctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 344 - skipped

SEQ ID NO: 345 - RNA, 1176 nt, synthetic construct
  source 1..1176: mol_type = other RNA
atgaaggccaagctgctggtgctgctgtgcacctttactgccacatacgccctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 346 - RNA, 1176 nt, synthetic construct
  source 1..1176: mol_type = other RNA
atgaaagccaaactgctggtgctgctgtgcaccttcacagccacctacgccctgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 347 - RNA, 1176 nt, synthetic construct
  source 1..1176: mol_type = other RNA
atgaaggccaagctgctggtgctgctgtgcacctttactgccacatacgccctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 348 - RNA, 1176 nt, synthetic construct
  source 1..1176: mol_type = other RNA
atgaaagccaaactgctggtgctgctgtgcaccttcacagccacctacgccctgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 349 - RNA, 1176 nt, synthetic construct
  source 1..1176: mol_type = other RNA
atgaaggctatcctggtggtgctgctgtatacttttgccaccgccaatgccctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 350 - RNA, 1176 nt, synthetic construct
  source 1..1176: mol_type = other RNA
atgaaggccattctggtggtgctgctgtataccttcgccacagccaatgcactgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 351 - RNA, 1176 nt, synthetic construct
  source 1..1176: mol_type = other RNA
atgaaggctatcctggtggtgctgctgtatacttttgccaccgccaatgccctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 352 - RNA, 1176 nt, synthetic construct
  source 1..1176: mol_type = other RNA
atgaaggccattctggtggtgctgctgtataccttcgccacagccaatgcactgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 353 - RNA, 1176 nt, synthetic construct
  source 1..1176: mol_type = other RNA
atgaaggctatcctggtggtgctgctgtatacttttgccaccgccaatgccctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 354 - RNA, 1176 nt, synthetic construct
  source 1..1176: mol_type = other RNA
atgaaggccattctggtggtgctgctgtataccttcgccacagccaatgcactgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 355 - RNA, 1176 nt, synthetic construct
  source 1..1176: mol_type = other RNA
atgaaggctatcctggtggtgctgctgtatacttttgccaccgccaatgccctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 356 - RNA, 1176 nt, synthetic construct
  source 1..1176: mol_type = other RNA
atgaaggccattctggtggtgctgctgtataccttcgccacagccaatgcactgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 357 - RNA, 873 nt, synthetic construct
  source 1..873: mol_type = other RNA
atgaaggccaagctgctggtgctgctgtgcacctttactgccacatacgccaacatgttcactccatatattggcgtcaaatggtcccgggccagcttcgacgccgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctaccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaac

SEQ ID NO: 358 - RNA, 873 nt, synthetic construct
  source 1..873: mol_type = other RNA
atgaaagccaaactgctggtgctgctgtgcaccttcacagccacctacgccaacatgtttacaccttacatcggggtgaagtggagcagagccagcttcgacgccgatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctacaattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaat

SEQ ID NO: 359 - RNA, 960 nt, synthetic construct
  source 1..960: mol_type = other RNA
atgaaggccaagctgctggtgctgctgtgcacctttactgccacatacgccaacatgttcactccatatattggcgtcaaatggtcccgggccagcttcgacgccgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctaccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggc

SEQ ID NO: 360 - RNA, 960 nt, synthetic construct
  source 1..960: mol_type = other RNA
atgaaagccaaactgctggtgctgctgtgcaccttcacagccacctacgccaacatgtttacaccttacatcggggtgaagtggagcagagccagcttcgacgccgatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctacaattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggc

SEQ ID NO: 361 - RNA, 873 nt, synthetic construct
  source 1..873: mol_type = other RNA
atgaaggccaagctgctggtgctgctgtgcacctttactgccacatacgccaacatgttcactccatatattggcgtcaaatggtcccgggccagcttcgacgccgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctgccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaac

SEQ ID NO: 362 - RNA, 873 nt, synthetic construct
  source 1..873: mol_type = other RNA
atgaaagccaaactgctggtgctgctgtgcaccttcacagccacctacgccaacatgtttacaccttacatcggggtgaagtggagcagagccagcttcgacgccgatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctgccattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaat

SEQ ID NO: 363 - RNA, 960 nt, synthetic construct
  source 1..960: mol_type = other RNA
atgaaggccaagctgctggtgctgctgtgcacctttactgccacatacgccaacatgttcactccatatattggcgtcaaatggtcccgggccagcttcgacgccgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctgccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggc

SEQ ID NO: 364 - RNA, 960 nt, synthetic construct
  source 1..960: mol_type = other RNA
atgaaagccaaactgctggtgctgctgtgcaccttcacagccacctacgccaacatgtttacaccttacatcggggtgaagtggagcagagccagcttcgacgccgatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctgccattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggc

SEQ ID NO: 365 - RNA, 1551 nt, synthetic construct
  source 1..1551: mol_type = other RNA
atgaaggccaagctgctggtgctgctgtgcacctttactgccacatacgccgacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatgagctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagagccagcttcgatgccgataccattaggattgctcagccaaaaagcgcaaccgccatttttgatactactactctgaatcccacaattgccggcgcaggcgatgtcaagactggggccgagggacagctgggagatacaatgcagatcgtgtccctgcagctgaacaacatgtttacaccatatattggtgtcaagtggagcagggccagctttgatgccgatactattagaatcgcccagcccaagtccgccacagcaatctttgacactacaaccctgaaccctaccattgctggcgccggggacgtgaaagcatccgccgaagggcagctgggcgatacaatgcagatcgtctccctgcagctcaataacatgttcaccccttacattggggtgaaatggagcagagccagctttgatagtgataccattcggattgctcagccccggctcgtcactcccgtggtggatattaccacactgaaccctactattgctgggagcggctctgtggctggcgctaatacggaaggccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccaacaattgccggaagcgggtctgtggtcgccgcaaactctgagggacagatctctgacactatgcagattgtgagcctgcagctgaac

SEQ ID NO: 366 - RNA, 1551 nt, synthetic construct
  source 1..1551: mol_type = other RNA
atgaaagccaaactgctggtgctgctgtgcaccttcacagccacctacgccgacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccgtgaaggccgagtccgtccctaatatgtctttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctagggccagctttgacgccgatacgattagaattgctcagcctaaaagcgccaccgcaattttcgatactactacactgaacccaaccatcgctggagcaggcgatgtgaagaccggcgcagagggacaactgggcgacactatgcagattgtgagtctgcagctcaataacatgttcactccttatattggggtgaaatggtccagagccagcttcgacgccgacaccatcagaattgctcagcccaagtctgctacagccatcttcgacaccactaccctgaacccaactattgctggagccggagacgtcaaagcctcagcagaggggcaactgggcgataccatgcagatcgtgtctctgcagctcaacaacatgtttaccccgtatattggcgtgaagtggtcacgggccagctttgactctgacacaattagaatcgcccagcctagactggtgacacccgttgttgacatcacaacactgaacccaacaatcgccggatctggcagcgtcgccggcgccaatactgagggccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccaaccattgctggaagcgggtccgtggtggccgcaaatagcgagggccagatttctgacaccatgcagattgtgtccctgcagctgaac

SEQ ID NO: 367 - RNA, 1554 nt, synthetic construct
  source 1..1554: mol_type = other RNA
atgaaggccaagctgctggtgctgctgtgcacctttactgccacatacgccgacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacaaacgtaaaagccgagagcgtgcctaatatggccttcgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagagccagcttcgatgccgataccattaggattgctcagccaaaaagcgcaaccgccatttttgatactactactctgaatcccgccatcgccggcgcaggcgatgtcaagactggggccgagggacagctgggagatacaatgcagatcgtgtccctgcagctgaacaacatgtttacaccatatattggtgtcaagtggagcagggccagctttgatgccgatactattagaatcgcccagcccaagtccgccacagcaatctttgacactacaaccctgaaccctgccatcgctggcgccggggacgtgaaagcatccgccgaagggcagctgggcgatacaatgcagatcgtctccctgcagctcaataacatgttcaccccttacattggggtgaaatggagcagagccagctttgatagtgataccattcggattgctcagccccggctcgtcactcccgtggtggatattaccacactgaaccctgccatcgctgggagcggctctgtggctggcgctaatacggaaggccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccagccatcgccggaagcgggtctgtggtcgccgcaaactctgagggacagatctctgacactatgcagattgtgagcctgcagctgaac

SEQ ID NO: 368 - RNA, 1554 nt, synthetic construct
  source 1..1554: mol_type = other RNA
atgaaagccaaactgctggtgctgctgtgcaccttcacagccacctacgccgacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccaacgtgaaggccgagtccgtccctaatatggccttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctagggccagctttgacgccgatacgattagaattgctcagcctaaaagcgccaccgcaattttcgatactactacactgaacccagccatcgctggagcaggcgatgtgaagaccggcgcagagggacaactgggcgacactatgcagattgtgagtctgcagctcaataacatgttcactccttatattggggtgaaatggtccagagccagcttcgacgccgacaccatcagaattgctcagcccaagtctgctacagccatcttcgacaccactaccctgaacccagccatcgctggagccggagacgtcaaagcctcagcagaggggcaactgggcgataccatgcagatcgtgtctctgcagctcaacaacatgtttaccccgtatattggcgtgaagtggtcacgggccagctttgactctgacacaattagaatcgcccagcctagactggtgacacccgttgttgacatcacaacactgaacccagccatcgccggatctggcagcgtcgccggcgccaatactgagggccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccagccatcgctggaagcgggtccgtggtggccgcaaatagcgagggccagatttctgacaccatgcagattgtgtccctgcagctgaac

SEQ ID NO: 369 - RNA, 1599 nt, synthetic construct
  source 1..1599: mol_type = other RNA
atgaaggcaaagctgctggtcctgctgtgcactttcaccgcaacctacgcagagtctctgagcaccaatgtgatcagcctggcagacaccaaggccaaggacaacacctcccacaaaagcaaaaaagccaggaagaaccactccaaggagacactggtggaccggaaagaggttgcacccgtgcatgagagcaaggccaccggccccaagcaggattcttgctttggacggatgtatacagtgaaggtgaatgatgacagaaacgtggagattactcaggctgtgcctgagtacgccaccgtggggtccccctaccctattgaaatcaccgcaaccgggaagagagactgtgttgacgtgatcatcacacagcagctgccctgtgaggctgagtttgtgaggagcgacccagctaccacccccactgccgatgggaagctggtgtggaagattgacaggctggggcagggagagaagtctaaaatcacagtgtgggtgaagcctctgaaagaaggatgttgctttacagccgcaacagtctgcgcatgtccagagattcgcagcgtgacaaaatgcgggcagcctgccatctgcgtgaagcaggagggaccagagaatgcttgcctgcgctgtccagtggtttacaaaatcaacgtggtgaaccagggcacagccatcgccagaaacgtggtggtggaaaaccccgtgcctgatggctacgcccattctagcggccagagagtgctgacttttacactgggggacatgcagcctggcgagcatcgcacaattactgtggagttctgtcccctgaagagaggccgggctaccaacatcgccacagtgtcttactgtggaggccacaagaatacagccagtgtcaccacagtgattaatgaaccatgtgtgcaggtgtctatcgcaggggctgattggtcctatgtgtgcaagcctgtggaatacgtgattagcgtgtccaaccctggggacctggttctgagagacgtggttgtggaggatacactgagccctggcgtgacagtgctggaggccgccggcgctcagatttcttgcaataaggtggtgtggacagtgaaagagctgaatcccggcgagagcctgcagtacaaggtgctggtgcgggcccagacccctggacagtttaccaataatgtggtcgtcaagtcctgctcagactgtggcacatgtacatcttgcgcagaggccacaacctattggaaaggggtcgccgcaacccacatgtgtgtggtggacacttgcgatcctgtgtgcgtcggagagaataccgtgtatcggatctgcgtgaccaacagaggcagcgcagaggacactaacgtgtccctgatgctgaaattttctaaggagctgcagcccgtgtccttttctggccctactaagggaaccattaccggaaacacagtggtgtttgactctctgcccagactgggctccaaggagacagttgagttctccgtgacactgaaagcagtgtcagccggagatgctagaggggaggccatcctgtcctctgacacactgaccgtgccagtcagcgacactgagaacacacacatttat

SEQ ID NO: 370 - RNA, 1599 nt, synthetic construct
  source 1..1599: mol_type = other RNA
atgaaggccaaactgctggtgctgctgtgtacatttactgccacctacgctgagagcctgtccaccaatgtgatttccctggccgacactaaggctaaagacaacacttcccacaaaagcaagaaagccagaaagaaccactcaaaggagacactggttgaccggaaagaagtggccccagtgcatgaaagcaaagccactggaccaaagcaggactcctgcttcggcagaatgtatacagttaaggtgaacgatgaccggaatgtggagatcactcaggccgtgccagagtacgccaccgtgggatctccttatccaattgagatcaccgccacagggaaaagggactgtgtggacgtgattattacacagcagctgccatgtgaagccgagttcgtgcgcagcgatccagccactactcccaccgccgatggaaaactggtgtggaagattgatcggctgggccagggcgagaagtctaaaattactgtgtgggtcaagcccctgaaagagggctgttgcttcaccgctgccactgtgtgtgcctgtccagagatccggtctgtgactaaatgtggccagccagcaatctgcgtgaagcaggagggaccagagaatgcttgtctgcgctgtcctgtggtgtataagattaatgtggtcaaccagggcaccgccattgctaggaacgtggtggtggaaaaccctgtgcccgatgggtatgcccattcttctgggcagagagtgctgacctttactctgggagatatgcagcctggcgagcacagaaccatcaccgtcgagttctgccccctgaaaagagggagagcaacaaacatcgccacagtgagctattgtggcggccacaaaaacaccgcctctgtgactaccgtcatcaatgagccttgtgtgcaggtgtcaatcgccggcgccgattggagctacgtgtgcaaacccgtggagtacgtcatttccgtgtcaaacccaggcgacctggtgctgagagatgtggtcgtggaggacactctgtctcctggcgtgacagtgctggaggcagccggcgcacaaatctcatgtaataaggtggtgtggacagtcaaagagctgaaccccggagagtctctgcagtacaaggtgctggtgagagcccagacacctggacaattcaccaacaacgtggtggtgaaatcctgttctgattgtggaacctgcacatcctgcgccgaggccactacctactggaaaggggttgccgccactcatatgtgcgtggtggatacatgcgacccagtgtgcgtgggcgagaatacagtgtacagaatttgcgtgactaaccgcggatctgccgaggatactaacgtgagcctgatgctgaagttctccaaggagctgcagcctgtttccttttccgggccaaccaagggcactattaccggcaacaccgttgtgttcgactctctgcctagactggggtctaaagaaacagtggaattttccgtgaccctgaaggccgtttccgccggagatgccaggggagaagcaatcctgagtagcgacacactgactgtgcccgtgagcgacacagagaacactcacatctat

SEQ ID NO: 371 - RNA, 1599 nt, synthetic construct
  source 1..1599: mol_type = other RNA
atgaaggcaaagctgctggtcctgctgtgcactttcaccgcaacctacgcagagtctctgagcaccaatgtgatcagcctggcagacaccaaggccaaggaccagacctcccacaaaagcaaaaaagccaggaagcagcactccaaggagacactggtggaccggaaagaggttgcacccgtgcatgagagcaaggccaccggccccaagcaggattcttgctttggacggatgtatacagtgaaggtgaatgatgacagaaacgtggagattactcaggctgtgcctgagtacgccaccgtggggtccccctaccctattgaaatcaccgcaaccgggaagagagactgtgttgacgtgatcatcacacagcagctgccctgtgaggctgagtttgtgaggagcgacccagctaccacccccactgccgatgggaagctggtgtggaagattgacaggctggggcagggagagaagtctaaaatcacagtgtgggtgaagcctctgaaagaaggatgttgctttacagccgcaacagtctgcgcatgtccagagattcgcagcgtgacaaaatgcgggcagcctgccatctgcgtgaagcaggagggaccagagaatgcttgcctgcgctgtccagtggtttacaaaatcaacgtggtgaaccagggcacagccatcgccagaaacgtggtggtggaaaaccccgtgcctgatggctacgcccattctagcggccagagagtgctgacttttacactgggggacatgcagcctggcgagcatcgcacaattactgtggagttctgtcccctgaagagaggccgggctaccaacatcgccacagtgtcttactgtggaggccacaagaatacagccagtgtcaccacagtgattaatgaaccatgtgtgcaggtgtctatcgcaggggctgattggtcctatgtgtgcaagcctgtggaatacgtgattagcgtgtccaaccctggggacctggttctgagagacgtggttgtggaggatacactgagccctggcgtgacagtgctggaggccgccggcgctcagatttcttgcaataaggtggtgtggacagtgaaagagctgaatcccggcgagagcctgcagtacaaggtgctggtgcgggcccagacccctggacagtttaccaataatgtggtcgtcaagtcctgctcagactgtggcacatgtacatcttgcgcagaggccacaacctattggaaaggggtcgccgcaacccacatgtgtgtggtggacacttgcgatcctgtgtgcgtcggagagaataccgtgtatcggatctgcgtgaccaacagaggcagcgcagaggacactcaggtgtccctgatgctgaaattttctaaggagctgcagcccgtgtccttttctggccctactaagggaaccattaccggaaacacagtggtgtttgactctctgcccagactgggctccaaggagacagttgagttctccgtgacactgaaagcagtgtcagccggagatgctagaggggaggccatcctgtcctctgacacactgaccgtgccagtcagcgacactgagaacacacacatttat

SEQ ID NO: 372 - RNA, 1599 nt, synthetic construct
  source 1..1599: mol_type = other RNA
atgaaggccaaactgctggtgctgctgtgtacatttactgccacctacgctgagagcctgtccaccaatgtgatttccctggccgacactaaggctaaagaccagacttcccacaaaagcaagaaagccagaaagcagcactcaaaggagacactggttgaccggaaagaagtggccccagtgcatgaaagcaaagccactggaccaaagcaggactcctgcttcggcagaatgtatacagttaaggtgaacgatgaccggaatgtggagatcactcaggccgtgccagagtacgccaccgtgggatctccttatccaattgagatcaccgccacagggaaaagggactgtgtggacgtgattattacacagcagctgccatgtgaagccgagttcgtgcgcagcgatccagccactactcccaccgccgatggaaaactggtgtggaagattgatcggctgggccagggcgagaagtctaaaattactgtgtgggtcaagcccctgaaagagggctgttgcttcaccgctgccactgtgtgtgcctgtccagagatccggtctgtgactaaatgtggccagccagcaatctgcgtgaagcaggagggaccagagaatgcttgtctgcgctgtcctgtggtgtataagattaatgtggtcaaccagggcaccgccattgctaggaacgtggtggtggaaaaccctgtgcccgatgggtatgcccattcttctgggcagagagtgctgacctttactctgggagatatgcagcctggcgagcacagaaccatcaccgtcgagttctgccccctgaaaagagggagagcaacaaacatcgccacagtgagctattgtggcggccacaaaaacaccgcctctgtgactaccgtcatcaatgagccttgtgtgcaggtgtcaatcgccggcgccgattggagctacgtgtgcaaacccgtggagtacgtcatttccgtgtcaaacccaggcgacctggtgctgagagatgtggtcgtggaggacactctgtctcctggcgtgacagtgctggaggcagccggcgcacaaatctcatgtaataaggtggtgtggacagtcaaagagctgaaccccggagagtctctgcagtacaaggtgctggtgagagcccagacacctggacaattcaccaacaacgtggtggtgaaatcctgttctgattgtggaacctgcacatcctgcgccgaggccactacctactggaaaggggttgccgccactcatatgtgcgtggtggatacatgcgacccagtgtgcgtgggcgagaatacagtgtacagaatttgcgtgactaaccgcggatctgccgaggatactcaggtgagcctgatgctgaagttctccaaggagctgcagcctgtttccttttccgggccaaccaagggcactattaccggcaacaccgttgtgttcgactctctgcctagactggggtctaaagaaacagtggaattttccgtgaccctgaaggccgtttccgccggagatgccaggggagaagcaatcctgagtagcgacacactgactgtgcccgtgagcgacacagagaacactcacatctat

SEQ ID NO: 373 - RNA, 597 nt, synthetic construct
  source 1..597: mol_type = other RNA
atgaaagccaagctgctggtgctgctgtgtacctttactgcaacatacgccaccacaaaacccaaaacactggagatcgacaataacacttttctgctgctggaaggaaatctgaagaggattttcgccacacctattggctacactacttttcgcgagtttcagaatgtggtgttcaactgcgcccagggacagcaggagctggctaatttcctgttcgagatgctgattaacggcaagctgctccaggagctgccagcaggccagaagcagtcagcccagagcctgatcgtgcagttcatgatgcctattagagtggctaaggacattcacgagagaggcgaattcatcaatttcatcacttctgacatgctggcccagcaggagcgctgcgtgttcctgaataggctgagcagggtggatggccaagagtttctgctgatgacagacgtgcagaatacctgccacctgattagacacctgctctccaggctgctggaagcccagaaaaacccaattggagaaaagaacctgcaggagatccaggaggatctggatagcctgcgggcacactttgaggagctgaccaagtctgtg

SEQ ID NO: 374 - RNA, 597 nt, synthetic construct
  source 1..597: mol_type = other RNA
atgaaggccaagctgctggtcctgctgtgcacattcacagctacctatgccacaacaaaacccaagaccctggaaattgacaacaatacctttctgctgctggagggcaacctgaaacgcatcttcgccacaccaattggctatacaacttttagagagttccagaacgtggttttcaactgcgcacagggacagcaggagctggccaacttcctgttcgaaatgctgatcaatgggaagctgctgcaggagctgccagccggccagaaacagtctgcacagtccctgattgtgcagttcatgatgcccattagggtggctaaggacatccacgagagaggcgagtttatcaattttatcacaagcgacatgctggctcagcaagaaaggtgcgtcttcctgaatcgcctgtcccgcgtggacggacaggagttcctgctgatgaccgacgtccaaaacacctgtcacttgatcagacacctgctgtccaggctgctggaggctcagaagaatccaatcggcgaaaagaatctgcaggagattcaggaagacctggactccctgcgcgcccacttcgaagaactgacaaaaagcgtg

SEQ ID NO: 375 - RNA, 597 nt, synthetic construct
  source 1..597: mol_type = other RNA
atgaaggccaaactgctggtgctgctgtgcactttcaccgccacctatgccacaaccaaacctaaaactctggaaatcgacaataacacattcctgctgctggaggggaacctgaagcggatttttgccaccccaatcggatacacaaccttcagggagtttcagaacgtggtgtttaactccgcccagggccagcaggagctggcaaatttcctgtttgaaatgctgattaatggcaagctgctgcaggaactgcccgccggacagaaacagtccgcccagagcctgattgtgcagtttatgatgcccatcagggtggctaaggatatccacgagagaggcgagttcattaacttcattaccagcgacatgctcgcccagcaggaaagatccgtgttcctgaaccggctgtctcgggtggatggacaggagttcctgctgatgaccgacgtgcaaaatacctctcacctgatccgccacctgctgtccagactgctggaggcccagaagaacccaattggcgagaaaaatctccaggaaatccaggaagacctggacagcctgagagcccacttcgaggagctgaccaagagcgtc

SEQ ID NO: 376 - RNA, 597 nt, synthetic construct
  source 1..597: mol_type = other RNA
atgaaggccaagctgctggtgctgctgtgtacttttaccgccacctacgcaactaccaaacccaagacactggagatcgacaataatacttttctgctgctggaggggaacctgaaacgcatttttgctacccctattggctacactacctttagagagttccagaacgtggtgttcaattccgcccagggacagcaggaactggccaacttcctgttcgaaatgctgatcaacggcaagctgctccaagagctgcctgccggacagaagcagagcgctcagtctctgatcgtgcagttcatgatgccaattcgggtggctaaggacatccatgagcgcggagagttcatcaactttatcacctccgatatgctggcccagcaggagaggagcgtgtttctgaacagactgagcagagttgacggacaggagttcctgctgatgaccgacgtgcagaacacctctcacctgatccggcacctgctgagtagactgctggaggcccagaaaaaccctattggcgagaaaaatctgcaggagattcaggaggatctggattcactccgcgcccacttcgaagaactgactaagagcgtg

SEQ ID NO: 377 - RNA, 597 nt, synthetic construct
  source 1..597: mol_type = other RNA
atgaaggccaagctgctggtgctgctgtgcacattcacagcaacatatgccacaaccaagcctaagaccctcgagatcgatcagaacaccttcctgctgctggagggcaacctgaagagaatctttgctactcctattggatatactaccttcagggagttccagaacgtggtgttcaattgcgcacaggggcagcaggaactggccaacttcctgttcgagatgctcatcaatggcaaactgctgcaggagctgccagctggccaaaagcagagcgcccagtctctcatcgtgcagttcatgatgcctatcagggtggccaaagacatccatgagaggggcgagtttatcaatttcatcacttccgatatgctggcccagcaggagagatgcgtgttcctgaatcggctgagcagggtcgatggacaggaattcctgctgatgaccgacgtgcaaaatacctgccacctgatcagacacctgctgagcagactcctggaggcccagaagaacccaatcggggaaaagaatctgcaggagatccaggaagacctggactctctgagagctcacttcgaggagctgaccaaaagcgtg

SEQ ID NO: 378 - RNA, 597 nt, synthetic construct
  source 1..597: mol_type = other RNA
atgaaagccaagctgctggtgctcctgtgcacattcactgccacttacgctaccacaaagccaaaaacactggagatcgaccagaatacattcctgctgctggaagggaatctgaaacggatcttcgccacccctatcggctataccacattccgcgaattccagaacgtcgtgttcaactgcgctcaaggccagcaggaactggccaacttcctgttcgaaatgctgatcaacggcaagctgctgcaggagctgcctgccggacagaaacagtctgcacagtctctgattgtgcagtttatgatgccaatcagggtggccaaggacatccatgagcgcggggagttcattaattttatcacctccgacatgctggcccagcaggaaaggtgtgtgtttctgaatcgcctgtccagagtggacggccaggaatttctgctgatgactgacgtgcagaacacctgtcacctgatcaggcacctgctgtctcggctgctggaggcacagaagaatcctatcggcgagaagaacctgcaggagattcaggaagacctggactctctccgggcccatttcgaggagctgactaagtctgtc

SEQ ID NO: 379 - RNA, 597 nt, synthetic construct
  source 1..597: mol_type = other RNA
atgaaggccaagctgctggtgctgctgtgcacattcaccgccacatacgctaccaccaaaccaaaaaccctggagattgaccagaatactttcctgctgctggaaggaaacctgaagaggatttttgccacaccaatcgggtatacaacattccgggagtttcagaacgtggtgtttaattccgctcaggggcagcaggagctggctaacttcctgttcgagatgctgatcaacggcaagctgctgcaagaactgccagccggccagaagcagagcgctcagtctctgattgtgcagtttatgatgccaattcgcgtggccaaagatatccacgagcgcggcgagttcattaatttcatcacctccgatatgctggcccagcaggagaggtccgtgttcctgaacagactgtccagagtggatgggcaggagtttctgctgatgaccgacgtgcagaacacttcccacctgatccgccacctgctgagcaggctgctcgaagcacagaagaatcctatcggagagaagaatctgcaggagatccaggaggatctggatagcctgcgggcacacttcgaggagctgaccaagagcgtc

SEQ ID NO: 380 - RNA, 597 nt, synthetic construct
  source 1..597: mol_type = other RNA
atgaaggccaagctgctggtgctgctgtgcacctttacagctacttatgccaccaccaagccaaagacactggaaattgaccagaacacatttctgctgctcgagggcaacctgaaaagaatttttgccactccaatcggctacaccacattcagggagtttcagaatgtggtgttcaattccgcccaggggcaacaggaactggcaaatttcctgtttgagatgctgatcaacgggaagctgctgcaggagctgccagctggccagaagcagtccgctcagagcctgatcgtgcagttcatgatgcccattagagtggctaaggacatccacgagcgcggcgaattcatcaacttcatcacatcagatatgctggctcagcaggagcggagcgtgttcctgaatcggctgtccagggtggatgggcaggagtttctgctgatgacagacgtccagaacaccagccacctgatccgacacctgctgtccagactgctggaggcccaaaagaaccccatcggggagaaaaacctgcaggagattcaggaggacctggacagcctgcgggcccacttcgaggaactcaccaagtctgtg

SEQ ID NO: 381 - RNA, 516 nt, synthetic construct
  source 1..516: mol_type = other RNA
atgaaggctaagctgctggtgctgctgtgcactttcactgccacttatgccgatagtgctaggcctcggaagtccagtttcggctttgtgccattctacagcgacgaggagattcagcaggcctttgtcgaggactttgattccaaggaggagcagctgtataagacatccgcccagagcactagcttcagaaacattaccttcgcaactgactcctactccatcaagggcgaagacaacctgaccatcctggccagcctggtgaggcacctgcacaaaagcccaaaagctaccctgtacattgagggacacactgacgaaaggggagccgcagcctataacctggctctgggagccagacgcgcaaacgctgtgaaacagtacctgatcaagcaggggatcgccgccgataggctgttcacaatttcctatgggaaagaacacccagtgcatccaggccacaatgagctggcttggcagcagaatcggaggactgagttcaagatccacgcccgc

SEQ ID NO: 382 - RNA, 516 nt, synthetic construct
  source 1..516: mol_type = other RNA
atgaaagccaaactgctggtgctgctgtgcacattcaccgccacctacgctgactcagctcgccctaggaaatctagctttggatttgtgcctttctatagcgacgaggaaattcagcaggcattcgtggaggactttgatagtaaggaggaacagctgtacaaaacctccgcccagagcacatccttcaggaatatcaccttcgccaccgactcctactcaattaagggagaggataatctgacaattctggcatctctggtccggcacctgcacaaaagccctaaagccacactgtatatcgagggacacaccgacgagagaggagccgccgcatacaacctggctctcggggctagaagggccaatgcagtcaagcagtacctgatcaagcagggaatcgccgccgaccggctgtttaccatcagctacggaaaagagcaccctgtgcatcctggccacaatgaactcgcatggcagcagaacaggagaactgagtttaagatccacgccaga

SEQ ID NO: 383 - RNA, 516 nt, synthetic construct
  source 1..516: mol_type = other RNA
atgaaagcaaagctgctggtgctcctgtgcactttcactgccacatacgccgacagcgcacggcctagaaagtccagcttcgggtttgtgcccttctatagcgacgaagagatccagcaggccttcgtggaggacttcgatagcaaggaggaacagctgtacaaaacctccgcccagtccacatccttccggcagatcacctttgctaccgatagctacagcatcaagggcgaagataacctggccatcctggcatccctggtgagacacctgcacaaaagccctaaggctaccctctacatcgagggacacacagacgaaaggggagctgccgcatataatctggctctgggcgcaagacgcgccaatgctgtgaaacagtacctgatcaaacagggcatcgccgctgaccgcctgttcacaattagctacggaaaagagcaccctgtgcatcccgggcataatgagctcgcctggcagcagaataggcggacagagttcaaaattcacgcccgc

SEQ ID NO: 384 - RNA, 516 nt, synthetic construct
  source 1..516: mol_type = other RNA
atgaaggccaaactgctggtgctgctgtgtacattcaccgccacttacgcagacagcgcaaggcccaggaaatccagcttcggattcgtgcccttctacagcgacgaggagatccagcaggctttcgtcgaagactttgattctaaggaggaacagctgtataagacatccgcacagtccacttccttcaggcagatcaccttcgctaccgactcttactccatcaaaggagaagataacctggccattctggcatccctggtgagacacctgcacaagtcccctaaagctacactgtacatcgaaggccatacagacgagagaggagccgcagcctataacctggcactgggagccaggcgcgcaaatgcagtgaagcagtacctgatcaagcaggggattgccgccgataggctgttcaccatcagctatgggaaggagcacccagtgcatccaggccataacgaactggcatggcagcaaaataggcgcaccgagtttaagatccatgccagg

SEQ ID NO: 385 - RNA, 2907 nt, synthetic construct
  source 1..2907: mol_type = other RNA
atgaaggccaagctgcttgtgctgctgtgtaccttcactgccacatatgcctcttcttttcaagagaaagatgccgataccctgccaggcaaggtggagcagtctaccctgttttccgtgacaaacccagtggtgttccagggagttgaccagcaggaccaggtgtcctctcagggcctgatttgcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcatgtgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaactgcgccgagctggtgtttaagggaaactgcgccatcgggactgaagacaagggctccctgggaggaggagccatcagctctctgggcacagtgctcctgcagggcaaccatggaattacctgtgataaaaatgagtctgccagccagggaggagccatcttcggcaaaaactgtcagatcagcgacaacgaaggacctgtggtgttcagggacagcacagcctgtctgggcggaggggcaattgcagcccaggagatcgtgtctatccagaacaaccaggctggaatctcctttgaagggggcaaggctagcttcggcggcggcatcgcctgcgagtcattcagctccgctggcggagccagcgtcttgggcgccattgatatcagcaagaacctcggcgccattagctttagtaggactctgtgtaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagtgttctgaagaggaagccactctcctgggctgttgcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagtgtgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctatttgcacacaaaacctgactatttcccagaacaccggcaacgtgctgttctacaataacgtcgcttgtagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagtgcattcacgtgcagcagggcagtctggagctgctgaacggagccaccctgtgcagctatggcttcaaacaggacgcaggcgctaaactggtcctggcttctgggtccaagctgaaaatcctg

SEQ ID NO: 386 - RNA, 2907 nt, synthetic construct
  source 1..2907: mol_type = other RNA
atgaaagccaagctgctggtcctgctgtgtacctttaccgccacctacgcttcctcctttcaagaaaaggatgctgataccctgcctggaaaagtggagcagtccaccctgttcagtgtgacaaaccccgtcgtgttccagggcgtcgaccagcaggatcaggtgtcctcccagggcctgatttgctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgcctgtgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaactgtgccgagctggtgtttaaagggaactgcgccattggcactgaggataagggaagtctggggggcggcgccatctccagcctggggacagtgctgctgcaggggaaccacgggattacctgcgacaaaaacgaaagcgcatcccagggcggagccatttttggcaagaactgccagatttctgataacgagggccccgttgttttcagggacagcaccgcttgtctgggcggcggcgcaattgctgcacaggagatcgtgtctattcagaacaaccaggcaggaatttcctttgaaggcggaaaggccagctttggcggcggcattgcatgcgagtccttctcctccgccggaggcgccagcgtgctgggcgcaattgatatctctaagaatctgggagcaatctccttctctcggactctgtgtactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagtgtagcgaggaggaggctactctgctgggctgttgcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagtgcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccatttgcacacagaatctgactatttcccagaacactggaaacgtgctgttttacaacaacgtggcatgctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagtgtattcatgtgcagcaggggagcctggaactgctgaatggcgccacactgtgttcctacggcttcaagcaggacgctggggctaagctggtgctggccagcggatctaaactgaaaatcctc

SEQ ID NO: 387 - RNA, 2907 nt, synthetic construct
  source 1..2907: mol_type = other RNA
atgaaggccaagctgcttgtgctgctgtgtaccttcactgccacatatgcctcttcttttcaagagaaagatgccgataccctgccaggcaaggtggagcagtctaccctgttttccgtgacaaacccagtggtgttccagggagttgaccagcaggaccaggtgtcctctcagggcctgattagcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcaagcgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaacagcgccgagctggtgtttaagggaaacagcgccatcgggactgaagacaagggctccctgggaggaggagccatcagctctctgggcacagtgctcctgcagggcaaccatggaattaccagcgataaaaatgagtctgccagccagggaggagccatcttcggcaaaaacagccagatcagcgacaacgaaggacctgtggtgttcagggacagcacagccagcctgggcggaggggcaattgcagcccaggagatcgtgtctatccagaacaaccaggctggaatctcctttgaagggggcaaggctagcttcggcggcggcatcgccagcgagtcattcagctccgctggcggagccagcgtcttgggcgccattgatatcagcaagaacctcggcgccattagctttagtaggactctgagcaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagagctctgaagaggaagccactctcctgggcagcagcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagagcgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctattagcacacaaaacctgactatttcccagaacaccggcaacgtgctgttctacaataacgtcgctagcagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagagcattcacgtgcagcagggcagtctggagctgctgaacggagccaccctgagcagctatggcttcaaacaggacgcaggcgctaaactggtcctggcttctgggtccaagctgaaaatcctg

SEQ ID NO: 388 - RNA, 2907 nt, synthetic construct
  source 1..2907: mol_type = other RNA
atgaaagccaagctgctggtcctgctgtgtacctttaccgccacctacgcttcctcctttcaagaaaaggatgctgataccctgcctggaaaagtggagcagtccaccctgttcagtgtgacaaaccccgtcgtgttccagggcgtcgaccagcaggatcaggtgtcctcccagggcctgattagctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgccagcgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaacagcgccgagctggtgtttaaagggaacagcgccattggcactgaggataagggaagtctggggggcggcgccatctccagcctggggacagtgctgctgcaggggaaccacgggattaccagcgacaaaaacgaaagcgcatcccagggcggagccatttttggcaagaacagccagatttctgataacgagggccccgttgttttcagggacagcaccgctagcctgggcggcggcgcaattgctgcacaggagatcgtgtctattcagaacaaccaggcaggaatttcctttgaaggcggaaaggccagctttggcggcggcattgcaagcgagtccttctcctccgccggaggcgccagcgtgctgggcgcaattgatatctctaagaatctgggagcaatctccttctctcggactctgagcactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagagcagcgaggaggaggctactctgctgggcagcagcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagagcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccattagcacacagaatctgactatttcccagaacactggaaacgtgctgttttacaacaacgtggcaagctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagagcattcatgtgcagcaggggagcctggaactgctgaatggcgccacactgagctcctacggcttcaagcaggacgctggggctaagctggtgctggccagcggatctaaactgaaaatcctc

SEQ ID NO: 389 - RNA, 3435 nt, synthetic construct
  source 1..3435: mol_type = other RNA
atgaaggccaagctgcttgtgctgctgtgtaccttcactgccacatatgcctcttcttttcaagagaaagatgccgataccctgccaggcaaggtggagcagtctaccctgttttccgtgacaaacccagtggtgttccagggagttgaccagcaggaccaggtgtcctctcagggcctgatttgcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcatgtgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaactgcgccgagctggtgtttaagggaaactgcgccatcgggactgaagacaagggctccctgggaggaggagccatcagctctctgggcacagtgctcctgcagggcaaccatggaattacctgtgataaaaatgagtctgccagccagggaggagccatcttcggcaaaaactgtcagatcagcgacaacgaaggacctgtggtgttcagggacagcacagcctgtctgggcggaggggcaattgcagcccaggagatcgtgtctatccagaacaaccaggctggaatctcctttgaagggggcaaggctagcttcggcggcggcatcgcctgcgagtcattcagctccgctggcggagccagcgtcttgggcgccattgatatcagcaagaacctcggcgccattagctttagtaggactctgtgtaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagtgttctgaagaggaagccactctcctgggctgttgcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagtgtgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctatttgcacacaaaacctgactatttcccagaacaccggcaacgtgctgttctacaataacgtcgcttgtagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagtgcattcacgtgcagcagggcagtctggagctgctgaacggagccaccctgtgcagctatggcttcaaacaggacgcaggcgctaaactggtcctggcttctgggtccaagctgaaaatcctggacagcggaaccccagtgcagggacatgctgttagtaaacctgaggccgagatcgagtccagcagcgagcctgaaggcgcccactctctgtggatcgctaagaacgcacagaccacagtgcctatggtggacattcacacgatctctgtggacctggccagcttctcctctagccagcaggagggcacagtggaggcacctcaggttatcgtgcccggaggctcttatgtgagatccggagagctgaatctggaactggttaacaccactggcacagggtatgagaatcacgccctgctgaagaacgaggctaaggtgcccctgatgtcctttgtggccagctctgatgaggccagcgcagagatcagcaacctgtctgtgagcgacctgcaaatccgggtggtgaccccagagatcgaagaagacacctacggccatatgggcgactggtccgaagcaaaaatccaggatggaactctggtgattaactggaaccccaccggatatcggctggacccccagaaggcc

SEQ ID NO: 390 - RNA, 3435 nt, synthetic construct
  source 1..3435: mol_type = other RNA
atgaaagccaagctgctggtcctgctgtgtacctttaccgccacctacgcttcctcctttcaagaaaaggatgctgataccctgcctggaaaagtggagcagtccaccctgttcagtgtgacaaaccccgtcgtgttccagggcgtcgaccagcaggatcaggtgtcctcccagggcctgatttgctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgcctgtgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaactgtgccgagctggtgtttaaagggaactgcgccattggcactgaggataagggaagtctggggggcggcgccatctccagcctggggacagtgctgctgcaggggaaccacgggattacctgcgacaaaaacgaaagcgcatcccagggcggagccatttttggcaagaactgccagatttctgataacgagggccccgttgttttcagggacagcaccgcttgtctgggcggcggcgcaattgctgcacaggagatcgtgtctattcagaacaaccaggcaggaatttcctttgaaggcggaaaggccagctttggcggcggcattgcatgcgagtccttctcctccgccggaggcgccagcgtgctgggcgcaattgatatctctaagaatctgggagcaatctccttctctcggactctgtgtactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagtgtagcgaggaggaggctactctgctgggctgttgcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagtgcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccatttgcacacagaatctgactatttcccagaacactggaaacgtgctgttttacaacaacgtggcatgctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagtgtattcatgtgcagcaggggagcctggaactgctgaatggcgccacactgtgttcctacggcttcaagcaggacgctggggctaagctggtgctggccagcggatctaaactgaaaatcctcgactccggaacccctgtgcaaggccatgctgtgagcaagcccgaggcagagatcgaatcctcttctgaacccgagggcgcccattccctgtggatcgccaaaaatgcacagaccacagtgcccatggtggacattcataccattagcgtcgacctggccagcttttccagctcacagcaggaaggcaccgtcgaggctccccaagtgattgtgcctggaggaagctacgtgcggagcggagagctgaacctggagctggtgaacaccactgggaccggatatgaaaaccacgccctgctcaagaacgaagccaaggtccctctgatgtcctttgtggcctccagcgatgaggcatccgcagagatcagcaatctgagcgtgagcgatctgcagattagggtggtgacacctgagattgaggaggacacttacggccacatgggagactggtccgaagctaagatccaggatggcaccctggtgatcaattggaaccctactggatatagactggacccacagaaggca

SEQ ID NO: 391 - RNA, 3435 nt, synthetic construct
  source 1..3435: mol_type = other RNA
atgaaggccaagctgcttgtgctgctgtgtaccttcactgccacatatgcctcttcttttcaagagaaagatgccgataccctgccaggcaaggtggagcagtctaccctgttttccgtgacaaacccagtggtgttccagggagttgaccagcaggaccaggtgtcctctcagggcctgattagcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcaagcgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaacagcgccgagctggtgtttaagggaaacagcgccatcgggactgaagacaagggctccctgggaggaggagccatcagctctctgggcacagtgctcctgcagggcaaccatggaattaccagcgataaaaatgagtctgccagccagggaggagccatcttcggcaaaaacagccagatcagcgacaacgaaggacctgtggtgttcagggacagcacagccagcctgggcggaggggcaattgcagcccaggagatcgtgtctatccagaacaaccaggctggaatctcctttgaagggggcaaggctagcttcggcggcggcatcgccagcgagtcattcagctccgctggcggagccagcgtcttgggcgccattgatatcagcaagaacctcggcgccattagctttagtaggactctgagcaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagagctctgaagaggaagccactctcctgggcagcagcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagagcgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctattagcacacaaaacctgactatttcccagaacaccggcaacgtgctgttctacaataacgtcgctagcagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagagcattcacgtgcagcagggcagtctggagctgctgaacggagccaccctgagcagctatggcttcaaacaggacgcaggcgctaaactggtcctggcttctgggtccaagctgaaaatcctggacagcggaaccccagtgcagggacatgctgttagtaaacctgaggccgagatcgagtccagcagcgagcctgaaggcgcccactctctgtggatcgctaagaacgcacagaccacagtgcctatggtggacattcacacgatctctgtggacctggccagcttctcctctagccagcaggagggcacagtggaggcacctcaggttatcgtgcccggaggctcttatgtgagatccggagagctgaatctggaactggttaacaccactggcacagggtatgagaatcacgccctgctgaagaacgaggctaaggtgcccctgatgtcctttgtggccagctctgatgaggccagcgcagagatcagcaacctgtctgtgagcgacctgcaaatccgggtggtgaccccagagatcgaagaagacacctacggccatatgggcgactggtccgaagcaaaaatccaggatggaactctggtgattaactggaaccccaccggatatcggctggacccccagaaggcc

SEQ ID NO: 392 - RNA, 3435 nt, synthetic construct
  source 1..3435: mol_type = other RNA
atgaaagccaagctgctggtcctgctgtgtacctttaccgccacctacgcttcctcctttcaagaaaaggatgctgataccctgcctggaaaagtggagcagtccaccctgttcagtgtgacaaaccccgtcgtgttccagggcgtcgaccagcaggatcaggtgtcctcccagggcctgattagctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgccagcgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaacagcgccgagctggtgtttaaagggaacagcgccattggcactgaggataagggaagtctggggggcggcgccatctccagcctggggacagtgctgctgcaggggaaccacgggattaccagcgacaaaaacgaaagcgcatcccagggcggagccatttttggcaagaacagccagatttctgataacgagggccccgttgttttcagggacagcaccgctagcctgggcggcggcgcaattgctgcacaggagatcgtgtctattcagaacaaccaggcaggaatttcctttgaaggcggaaaggccagctttggcggcggcattgcaagcgagtccttctcctccgccggaggcgccagcgtgctgggcgcaattgatatctctaagaatctgggagcaatctccttctctcggactctgagcactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagagcagcgaggaggaggctactctgctgggcagcagcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagagcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccattagcacacagaatctgactatttcccagaacactggaaacgtgctgttttacaacaacgtggcaagctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagagcattcatgtgcagcaggggagcctggaactgctgaatggcgccacactgagctcctacggcttcaagcaggacgctggggctaagctggtgctggccagcggatctaaactgaaaatcctcgactccggaacccctgtgcaaggccatgctgtgagcaagcccgaggcagagatcgaatcctcttctgaacccgagggcgcccattccctgtggatcgccaaaaatgcacagaccacagtgcccatggtggacattcataccattagcgtcgacctggccagcttttccagctcacagcaggaaggcaccgtcgaggctccccaagtgattgtgcctggaggaagctacgtgcggagcggagagctgaacctggagctggtgaacaccactgggaccggatatgaaaaccacgccctgctcaagaacgaagccaaggtccctctgatgtcctttgtggcctccagcgatgaggcatccgcagagatcagcaatctgagcgtgagcgatctgcagattagggtggtgacacctgagattgaggaggacacttacggccacatgggagactggtccgaagctaagatccaggatggcaccctggtgatcaattggaaccctactggatatagactggacccacagaaggca

SEQ ID NO: 393 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctgtaa

SEQ ID NO: 394 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 395 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 396 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 397 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 398 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 399 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctgtaa

SEQ ID NO: 400 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 401 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 402 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 403 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 404 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 405 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctgtaa

SEQ ID NO: 406 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 407 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 408 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 409 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 410 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 411 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctgtaa

SEQ ID NO: 412 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 413 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 414 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 415 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 416 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 417 - RNA, 2910 nt, synthetic construct
  source 1..2910: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 418 - RNA, 2910 nt, synthetic construct
  source 1..2910: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 419 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 420 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 421 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 422 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 423 - RNA, 3438 nt, synthetic construct
  source 1..3438: mol_type = other RNA
atgaaggccaagctgctggtgctcctgtgcaccttcaccgccacttacgcatcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 424 - RNA, 3438 nt, synthetic construct
  source 1..3438: mol_type = other RNA
atgaaggctaagctgctggtgctgctgtgtacctttactgcaacatatgcctcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 425 - RNA, 1182 nt, synthetic construct
  source 1..1182: mol_type = other RNA
atgaagaaattactgaaaagcgtcctggttttcgccgccctgtcctccgcgtcctcactgcaagccctccccgtcggaaatcctgccgagccttcgctcatgatcgacgggatattgtgggaagggtttgggggcgatccctgcgacccctgcacgacttggtgcgacgcaatttcgatgcggatgggctattacggcgatttcgtattcgaccgcgtgctcaagactgacgtgaacaaggaattccagatgggcgacaagccgacctcaactaccggaaacgctaccgccccgactaccctgaccgcccgggaaaaccccgcctacggccggcacatgcaggatgccgagatgttcaccaacgccgcgtgcatggccctgaacatttgggacagattcgacgtgttctgcaccctgggtgcctcctccggataccttaagggaaacagcgcctcattcaacttagtgggactttttggagacaacgaaaaccaatccaccgtcaaaactaacagcgtgccaaacatgagcctggatcagagcgtggtggaattgtacaccgataccgcgttctcgtggagcgtgggagccagggcagcgctgtgggagtgtggctgcgccaccttgggcgcttccttccaatacgcgcagtccaagcctaaggtcgaggagcttaacgtcctgtgcaatgccgcggaattcactatcaacaagccgaagggttacgtgggacaggaatttcccctggccctgatcgcggggaccgacgccgccactggaaccaaggacgccagtattgactaccacgagtggcaggcgtcactggccctgtcgtaccgcctcaacatgttcaccccgtacattggcgtgaagtggagcagagcttccttcgacgccgacacgatccggattgcccagcctaagtccgccacagcgatcttcgacaccactaccctgaacccgaccatcgccggtgctggcgatgtgaaggcttccgccgagggacagctcggggacaccatgcagattgtctccctgcaactcaacaagatgaagtcccggaagtcgtgcggtatcgcagtgggaactaccatcgtggacgccgataagtacgccgtcaccgtggagactaggctcatcgacgaacgggctgcacacgtgaacgcacagttccgcttctaa

SEQ ID NO: 426 - RNA, 1209 nt, synthetic construct
  source 1..1209: mol_type = other RNA
atggactccaagggatcgtcacagaaaggctcacgcttgctactcctcctcgtggtgtctaacttgctcctgccgcaaggggtgctcgccatgctccccgtcggaaatcctgccgagccttcgctcatgatcgacgggatattgtgggaagggtttgggggcgatccctgcgacccctgcacgacttggtgcgacgcaatttcgatgcggatgggctattacggcgatttcgtattcgaccgcgtgctcaagactgacgtgaacaaggaattccagatgggcgacaagccgacctcaactaccggaaacgctaccgccccgactaccctgaccgcccgggaaaaccccgcctacggccggcacatgcaggatgccgagatgttcaccaacgccgcgtgcatggccctgaacatttgggacagattcgacgtgttctgcaccctgggtgcctcctccggataccttaagggaaacagcgcctcattcaacttagtgggactttttggagacaacgaaaaccaatccaccgtcaaaactaacagcgtgccaaacatgagcctggatcagagcgtggtggaattgtacaccgataccgcgttctcgtggagcgtgggagccagggcagcgctgtgggagtgtggctgcgccaccttgggcgcttccttccaatacgcgcagtccaagcctaaggtcgaggagcttaacgtcctgtgcaatgccgcggaattcactatcaacaagccgaagggttacgtgggacaggaatttcccctggccctgatcgcggggaccgacgccgccactggaaccaaggacgccagtattgactaccacgagtggcaggcgtcactggccctgtcgtaccgcctcaacatgttcaccccgtacattggcgtgaagtggagcagagcttccttcgacgccgacacgatccggattgcccagcctaagtccgccacagcgatcttcgacaccactaccctgaacccgaccatcgccggtgctggcgatgtgaaggcttccgccgagggacagctcggggacaccatgcagattgtctccctgcaactcaacaagatgaagtcccggaagtcgtgcggtatcgcagtgggaactaccatcgtggacgccgataagtacgccgtcaccgtggagactaggctcatcgacgaacgggctgcacacgtgaacgcacagttccgcttctaa

SEQ ID NO: 427 - RNA, 1209 nt, synthetic construct
  source 1..1209: mol_type = other RNA
atggactccaagggatcgtcacagaaaggctcacgcttgctactcctcctcgtggtgtctaacttgctcctgccgcaaggggtgctcgccatgctccccgtcggaaatcctgccgagccttcgctcatgatcgacgggatattgtgggaagggtttgggggcgatccctgcgacccctgcgcgacttggtgcgacgcaatttcgatgcgggtgggctattacggcgatttcgtattcgaccgcgtgctcaagactgacgtgaacaaggaattccagatgggcgccaagccgaccacggataccggaaactccgccgccccgtccaccctgaccgcccgggaaaaccccgcctacggccggcacatgcaggatgccgagatgttcaccaacgccgcgtgcatggccctgaacatttgggacagattcgacgtgttctgcaccctgggtgccacttccggataccttaagggaaacagcgcctcattcaacttagtgggactttttggagacaacgaaaaccaaaagaccgtcaaagccgagagcgtgccaaacatgagcttcgatcagagcgtggtggaattgtacaccgataccaccttcgcgtggagcgtgggagccagggcagcgctgtgggagtgtggctgcgccaccttgggcgcttccttccaatacgcgcagtccaagcctaaggtcgaggagcttaacgtcctgtgcaatgccgcggaattcactatcaacaagccgaagggttacgtgggaaaagaatttcccctggacctgactgcggggaccgacgccgccactggaaccaaggacgccagtattgactaccacgagtggcaggcgtcactggccctgtcgtaccgcctcaacatgttcaccccgtacattggcgtgaagtggagcagagcttccttcgacgccgacacgatccggattgcccagcctaagtccgccacagcgatcttcgacaccactaccctgaacccgaccatcgccggtgctggcgatgtgaagactggagccgagggacagctcggggacaccatgcagattgtctccctgcaactcaacaagatgaagtcccggaagtcgtgcggtatcgcagtgggaactaccatcgtggacgccgataagtacgccgtcaccgtggagactaggctcatcgacgaacgggctgcacacgtgaacgcacagttccgcttctaa

SEQ ID NO: 428 - RNA, 1191 nt, synthetic construct
  source 1..1191: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 429 - RNA, 1149 nt, synthetic construct
  source 1..1149: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgggggcggaggaggcggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 430 - RNA, 1101 nt, synthetic construct
  source 1..1101: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcgggggcggaggaggcgggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 431 - RNA, 1068 nt, synthetic construct
  source 1..1068: mol_type = other RNA
atgaaaaagctgctgaagtctgtgctggtgttcgccgctctgtcctctgcttcctccctgcaagccctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatggggggcggaggaggcgggaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgggggaggcggagggagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggggcggaggaggcgggacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgggggcggaggaggcggggacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttcatcaccatcatcaccatcaccacggaggatctggcggatccggaggatctgcctggtctcacccacagttcgagaagtga

SEQ ID NO: 432 - RNA, 1197 nt, synthetic construct
  source 1..1197: mol_type = other RNA
atgctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatgggggataagcccacaagcaccactgggaatgccaccgcccccacaaccctgacagctcgggaaaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgacaatgagaaccagagcacagtcaaaaccaactccgtgcccaatatgtccctggatcagagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggcaggagtttcctctggctctgattgccggcacagacgctgccacaggcacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgccaccgctatttttgacaccacaacactgaatcccaccattgctggggccggcgatgtgaaagccagcgctgagggacagctgggcgacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttcatcaccatcatcaccatcaccacggaggatctggcggatccggaggatctgcctggtctcacccacagttcgagaagtga

SEQ ID NO: 433 - RNA, 4680 nt, synthetic construct
  source 1..4680: mol_type = other RNA
atgtcatctgagaaagacatcaaatctacatgcagcaagttttccctgagcgtggtcgccgccatcctggcttccgtttccggacttgcctcctgtgtggatctgcacgccggaggccagagcgtgaatgaactggtgtatgtcgggccacaggctgtcctgctgctggaccagattagggacctctttgtgggctccaaagactctcaggccgagggccagtatagactcattgtgggggatccttccagctttcaggagaaggacgctgacactctgcccggcaaagtggaacagtctaccctgttctccgtgaccaaccccgtcgtcttccagggggtggaccagcaggaccaggtttctagccagggcctgatttgctccttcaccagctccaacctggacagtcctcgcgatggcgagtccttcctggggatcgcctttgtgggagactcctctaaggccggcatcactctgacagatgtgaaagcctccctgtccggcgccgctctgtacagcactgaggacctgatcttcgagaagattaagggcgggctggagtttgcctcctgtagttccctggagcagggaggcgcttgcgccgcccagtccatcttgattcatgattgtcagggactgcaggttaaacactgtaccacagcagtgaatgctgagggctcctctgccaatgaccatctgggctttgggggaggagcattcttcgtgacagggagcctgtccggcgaaaaaagcctgtacatgccagccggcgatatggtcgtggccaattgcgatggagcaatctcctttgaggggaattccgccaatttcgccaacggcggcgccatcgccgcatccggcaaggtgctgtttgtggcaaacgacaagaagaccagcttcattgagaaccgcgccctgtcaggcggagccatcgccgcatcctctgacatcgcctttcagaattgtgcagagctggtgttcaagggcaactgcgcaatcggcaccgaggataaaggaagcctggggggaggcgctatttcctcactgggcactgtgctgctccaggggaatcacggcattacctgcgataaaaacgaaagtgccagccagggcggcgcaatcttcggcaaaaactgtcagatttccgataacgagggcccagtcgtgttcagagattccacagcttgcctgggcgggggagccattgccgctcaggagatcgtgagcatccagaataatcaggctgggatctccttcgagggcgggaaggccagctttggcggcggcatcgcttgtgagtccttctccagcgccggaggcgcttctgtcctgggcgcaatcgatatctccaagaacctgggcgccatttctttcagcaggactctgtgcactacctccgacctgggccaaatggagtaccagggaggaggcgccctgttcggcgaaaatatttccctgtccgagaatgccggcgtgctgactttcaaggacaatattgtgaaaacctttgcctctaatggaaagatcctgggaggcggagctattctggccaccggaaaagtggagatcacaaataactccggaggcatttctttcacagggaatgccagagccccacaggccctgcctacccaggaagagttcccactgttctccaagaaggaaggccgcccactgtcaagcggatacagcggcggaggcgctatcctggggagagaggtggctattctgcataacgctgctgtggtgttcgagcagaatagactccagtgtagcgaggaggaagcaaccctgctggggtgttgcgggggaggagccgtgcacggaatggactccactagcattgtgggaaactcaagcgtccgctttggcaacaactacgctatgggacagggcgtgagcggaggcgcactcctgtctaagacagtgcagctggccggcaatggctctgtcgacttctccagaaacattgcctctctggggggcggcgccctgcaggcctctgagggcaattgcgagctggtggataatgggtacgtgctgttcagggataacagagggagggtgtatggcggagcaatttcttgcctgagaggcgacgtggttatctccggcaacaaagggagggtggagtttaaggataacattgccacaagactgtacgtggaggaaaccgtcgaaaaggttgaggaggtggaacccgcccctgagcagaaggacaataatgagctgagctttctgggcagtgctgagcagtcttttattacagctgccaatcaggccctgttcgcatccgaggatggagatctctccccagagagcagcatcagcagcgaggagctggccaagcggagagagtgcgccggaggcgcaatctttgccaagagagtcagaattgttgacaatcaggaggcagtggtgttcagcaataatttttccgacatctatgggggcgccattttcacaggcagcctgagagaggaagacaaactcgatgggcagattccagaagtgctgatctccggcaacgctggcgatgtcgtgttcagcgggaactccagtaagagggatgaacatctcccacacacaggaggcggagccatctgcacacagaatctgacaatctcccagaacaccggcaacgtgctgttctacaacaacgtggcctgcagcggcggggcagtgagaattgaggatcacgggaatgtgctgctcgaggcctttggcggcgatatcgtctttaaggggaatagcagctttagggctcaggggtccgacgctatctacttcgctggcaaggaatctcatatcaccgcactgaacgccactgagggacacgcaatcgtgtttcacgatgccctggtgtttgagaacctggaggagcgcaaaagcgccgaggtgctgctgatcaactcacgcgagaatcctggctatacaggctccattcggttcctggaagcagaaagcaaagtgcctcagtgcatccacgtgcagcagggatccctggaactgctgaacggggccaccctctgctcttacgggttcaagcaggatgctggggctaagctggtgctggccagcggaagcaagctgaaaattctggattctggaacaccagtgcagggacacgccgtgagcaaacctgaagctgagattgagagctctagcgagcccgagggagctcattctctgtggattgcaaaaaacgcacagactaccgtgccaatggttgacatccacaccatcagcgtggacctggccagctttagtagcagccagcaggagggaacagtggaagccccccaggtcatcgtgcctggcggatcttacgtgaggagcggcgaactgaacctggagctggtgaatactaccgggacagggtacgagaaccacgccctgctgaaaaacgaggccaaggtgcctctgatgtctttcgtggcaagctctgacgaggctagcgcagagattagcaacctgtctgtgtccgacctgcagatccgcgtcgtcactccagagatcgaggaagacacctatggccacatgggcgactggagcgaagccaaaattcaggacggaaccctggtcatcaattggaaccctactggctacagactggacccacagaaggctggcgccctggtgtttaacgctctgtgggaggagggcgccgtcctgtctgcactgaaaaacgctagattcgcacacaacctgactgcccagaggatggaattcgactactctaccaacgtgtggggatttgcctttggcgggttccggacactgagcgcagagaacctggttgccatcgatggatataaaggcgcttacggctctgcatctgcaggcgtggatatccagctgatggaggactttgtgctgggcgtgagcggggcagcttttctgggcaaaatggatagccagaagtttgacgcagaagtcagccggaagggcgtggtcggctccgtgtatactggctttctggccggaagctggttcttcaaggggcagtacagcctgggcgaaacccagaatgatatgaaaacaagatacggcgtcctgggagagtcctccgctagctggacaagcagaggggtgctcgcagatgccctggtggagtatcgctccctggtgggcccagtgaggcccacattttacgccctgcacttcaacccttatgttgaagtgtcctatgcctccatgaaattccccggattcacagagcagggacgggaggcccggtcttttgaggatgcaagcctgaccaacatcaccatcccactgggcatgaagttcgaacttgcctttatcaagggacagttctccgaggttaactccctgggcatctcctatgcttgggaggcatacagaaaagtggagggaggcgccgtgcagctgctggaggcaggctttgattgggagggcgctcctatggatctgcctagacaggagctgcgggtggccctggagaataacactgagtggtcttcctatttttctactgtgctcggcctgactgccttttgcggagggttcacatccaccgccagcaagctgggctatgaggctaacgccggcctgcggctgatcttcggctcctctcaccatcaccaccatcaccatcatggagggtctggaggctctggaggatctgcatggagccacccccagtttgaaaagtaa

SEQ ID NO: 434 - RNA, 2373 nt, synthetic construct
  source 1..2373: mol_type = other RNA
atgtcatctgagaaagacatcaaatctacatgcagcaagttttccctgagcgtggtcgccgccatcctggcttccgtttccggacttgcctcctgtgtggatctgcacgcaggagggcagagcgttaacgagctggtgtatgtgggaccccaggctgtcctgctgctggaccagatccgcgacctctttgtggggtccaaggacagccaggctgagggacagtacagactcatcgtcggcgacccatcttccttccaggagaaggacgccgatactctgcccgggaaggtggagcagtctacactgttcagcgtgaccaacccagttgtgtttcagggggtggaccagcaggaccaggtgtcttcccagggcctgatctgcagcttcacatcctccaacctcgacagccctcgcgacggcgagtctttcctggggattgccttcgtgggcgacagctccaaagccgggatcaccctgacagacgtcaaggcttccctgtccggcgctgcactgtactctaccgaggacctgatcttcgagaaaattaagggaggcctggagttcgcttcttgttcttctctggaacagggcggcgcatgtgctgcacagtccatcctgattcacgattgtcaaggactccaggtgaaacattgcacaactgccgtgaatgcagagggatcctccgccaatgaccacctgggatttggaggcggcgcattctttgtgacagggtccctctccggcgagaagtctctgtacatgccagctggagacatggtcgtggccaactgtgacggcgcaatcagcttcgagggaaatagcgcaaattttgccaatggaggcgctatcgccgctagcggcaaagtgctgttcgtggctaatgacaagaaaacatccttcatcgagaacagagccctgtctggcggagctattgcagccagtagcgatatcgccttccagaactgcgcagaactggtgttcaaaggcaactgtgctatcggcaccgaggataaaggaagtctgggcgggggggccatctcctctctgggcacagtgctgctgcagggcaatcacggaattacctgtgacaagaatgagagcgcaagccaggggggcgcaatttttggcaagaactgccagatctccgacaatgagggccctgtggtgttcagagatagtaccgcatgtctgggcgggggagccattgccgcccaggagatcgtgagcattcagaacaatcaggccggcattagctttgaggggggaaaggctagcttcggagggggaatcgcttgcgaatccttctcttctgcaggaggggccagcgtcctgggagcaatcgacatctccaagaacctgggcgccattagtttcagcagaaccctgtgcaccacttccgacctgggccagatggaatatcagggcggaggggccctctttggcgaaaatatctctctgagcgagaacgctggggttctgactttcaaggataacattgtgaaaaccttcgcctctaacggaaagattctgggaggcggagccattctggccaccggcaaagtggagattaccaataacagcggcggaatcagctttaccggaaatgcaagagctcctcaggctctgcctacacaggaagaattccccctgtttagcaaaaaggagggaagacccctgagcagcggatacagcggagggggagctattctgggaagagaggtggccatcctgcacaatgccgctgtggtgttcgagcagaaccggctgcagtgtagtgaggaagaggcaaccctgctgggatgttgtggggggggggcagtgcatggcatggatagcacatccatcgtgggcaattcttccgtccggtttggcaataattacgccatggggcagggagtgtctggaggcgcactgttgtctaagacagtgcagctggcaggcaacggctccgtggacttctccagaaacattgcatctctcggaggaggagctctgcaggcatctgagggaaattgcgagctggtggacaacggatacgtgctgtttcgcgataaccgcggcagagtctacgggggcgcaattagctgcctgcggggggatgtggtcatctccggaaacaagggcagagtggagttcaaggataacattgctacccggctgtatgtggaggaaaccgtggagaaagtggaagaggtcgagccagccccagaacagaaagacaataacgagctgtctttcctgggaagcgccgaacagtcctttatcacagccgccaatcaggcaggctcctctcaccatcaccaccatcaccatcatggagggtctggaggctctggaggatctgcatggagccacccccagtttgaaaagtaa

SEQ ID NO: 435 - RNA, 2340 nt, synthetic construct
  source 1..2340: mol_type = other RNA
atgaaggccaagctcctggtgctcctgtgtacttttacagcaacttatgctgacaccatttgtgtggatctgcacgccggcggccagagtgtgaacgagctggtgtacgtcggcccccaggctgtgctgctgctggatcagatcagggacttgttcgttggcagcaaggacagccaggcagagggccagtatagactgattgtgggagatccaagctcctttcaggagaaagacgccgacactctgcccgggaaggtggagcagagcacactgttcagcgtgactaaccccgtggtgtttcagggggtggaccagcaggatcaggtgagctcccagggactgatctgcagtttcacttcttctaacctagacagccctagggacggcgagtctttcctggggattgctttcgtgggcgacagcagcaaggcagggatcactctcaccgacgtgaaggccagcctgtccggtgctgctctgtattccaccgaggacctgatctttgagaagattaagggcggcctggagttcgcttcttgctctagcctcgaacagggaggagcctgtgctgctcagagcatcctgatccacgattgccagggactgcaggtcaagcactgtacaacagccgtcaatgctgaagggtctagcgccaatgaccacctgggctttggcggcggggccttctttgtgaccggctcactgagcggagaaaagtctctgtacatgcctgccggggatatggtggtggccaactgcgatggcgcaatttccttcgaagggaattctgccaacttcgccaacggcggagctatcgctgcaagcggcaaggtgctgttcgtggccaatgataagaagacatcctttatcgagaatcgggcactgtccgggggagccatcgccgccagctccgacatcgcctttcagaattgcgctgagctggtgttcaaggggaattgtgcaatcggcactgaggacaagggcagcctgggcgggggcgccatttcatctctgggaactgtcctgctgcagggaaaccatggcattacatgtgacaagaacgagtccgcatcccagggcggagccatcttcggcaaaaattgccagatttctgacaatgaaggcccagtggtgtttcgggactctaccgcctgcctgggaggaggggccatcgctgctcaggaaatcgtgagcattcagaacaatcaagccggcatctcctttgaaggaggcaaagcctccttcggcggcggaattgcatgtgagtccttctctagcgccggaggagctagcgttctgggagctatcgatatttcaaagaacctgggcgcaatcagcttttccaggactctgtgtaccacttctgacctgggccagatggagtaccagggaggaggagccctgtttggagagaacatctctctgtcagagaacgccggcgtgctgacattcaaggacaacatcgtgaagaccttcgcttccaacggaaagatcctcggcggcggcgctattctggctacaggcaaagtggaaattactaacaacagcggggggatctccttcactggaaacgcccgcgcaccccaagcactgcctacccaggaagagtttcccctgttcagcaaaaaggagggcaggcccctgagttcaggctattccggcggaggcgcaatcctggggagagaggtggccattctgcacaacgccgctgtggtgtttgagcagaacagactgcagtgttccgaggaggaggcaacactgctgggatgctgtggaggaggagcagtgcacggcatggatagcactagcatcgtgggcaactcatccgtgagatttggaaataattacgccatgggccagggagtttcaggcggcgctctgctgtccaagactgtgcagctggctggaaacggcagcgtggatttcagccggaatattgctagcctggggggaggggcactgcaggcctctgaaggaaattgcgagctggtggataatgggtacgtgctgttcagagataaccgggggagggtgtacggcggagctatttcatgtctgcgcggagacgtggtcatctccggaaacaagggcagggtggagttcaaagacaatatcgccacaagactgtatgtggaggaaaccgtggagaaggtcgaggaggtggagcctgcccctgagcagaaggacaataacgaactcagctttctgggcagcgccgagcagtcattcatcactgccgccaaccaggcaggatcttcccatcaccatcatcaccatcaccacggaggatctggcggatccggaggatctgcctggagccacccacagttcgagaagtaa

SEQ ID NO: 436 - RNA, 654 nt, synthetic construct
  source 1..654: mol_type = other RNA
atgcgcaaaacaatctttaaggccttcaacctgctgtttagcctgctgttcctgtctagctgctcttatccctgccgggattgggagtgtcacggctgcgactctgcacgcccacggaaatcttccttcggctttgtgccattctattctgatgaggagattcagcaggcctttgtggaggattttgattccaaggaggaacagctgtacaagacctctgcacagtctacaagtttccgcaacatcaccttcgccaccgattcttacagcatcaagggggaggacaacctgactattctggcaagcctggtgcgccatctgcataaatcccccaaagctaccctgtacattgagggccacacagatgaacgcggcgcagctgcctacaatctggctctgggagccaggagggcaaatgccgtgaagcagtacctgatcaaacagggcattgctgccgataggctgttcacaatcagctatgggaaagagcatcctgtgcacccagggcacaacgagctggcttggcagcagaataggagaacagagttcaagatccacgctagaggctcctctcaccatcaccaccatcaccatcatggagggtctggaggctctggaggatctgcatggagccacccccagtttgaaaagtaa

SEQ ID NO: 437 - RNA, 654 nt, synthetic construct
  source 1..654: mol_type = other RNA
atgaaggccaagctcctggtcctgctgtgtactttcaccgctacctatgccgataccatctgcagctatccatgtagggactgggagtgccatgggtgcgattctgctcggcctagaaagtcctcctttgggttcgtgcctttctacagcgatgaggagattcagcaggctttcgtggaggattttgacagcaaggaggagcagctgtataagacaagcgcacagtctacttcttttaggaatatcaccttcgccaccgatagctactccatcaagggggaagacaacctgacaattctggcctctctggtgcggcatctgcacaagagccctaaagctactctctatatcgagggacatacagatgagcggggcgccgccgcatacaatctggctctgggagccagaagggcaaacgccgtgaagcagtacctgattaagcagggaatcgccgccgacagactgtttacaatcagctacggcaaagaacacccagtgcatcctgggcataatgagctcgcctggcagcagaacaggagaacagagttcaaaatccacgcccgcggctcctctcaccatcaccaccatcaccatcatggagggtctggaggctctggaggatctgcatggagccacccccagtttgaaaagtaa

SEQ ID NO: 438 - RNA, 1731 nt, synthetic construct
  source 1..1731: mol_type = other RNA
atgaacaagctcatcaggagggctgtgaccatctttgccgtgactagcgtggcttccctgttcgcctctggggtgctggagacttctatggccgagagcctctccactaacgtcattagcctggcagataccaaagcaaaggacaatacaagccacaagagcaagaaagctaggaagaaccactccaaggagacactggtggatagaaaggaagtggctccagtgcacgagtctaaagccacagggcccaaacaggactcctgcttcggcaggatgtataccgtgaaggtgaacgacgatcgcaatgtggagatcacccaggccgtgcctgagtatgctacagtgggatctccatatccaattgagatcactgccactgggaaacgcgactgcgtggatgtgattattactcagcagctgccttgtgaggccgagttcgtgcggtctgaccctgctaccactcctacagctgatggaaagctggtgtggaagatcgacagactggggcagggagagaaaagcaagatcaccgtgtgggtgaaacctctgaaggaaggatgctgttttaccgccgccactgtttgtgcttgccctgaaatcaggtccgtgactaagtgtggccagcccgctatctgcgtcaagcaggagggccctgaaaatgcatgcctgaggtgcccagtggtttacaagattaatgtggtgaaccagggaaccgccattgccaggaatgttgtggtggagaaccccgtgcctgacgggtatgcccacagctctgggcagagggtgctgaccttcacactcggcgatatgcagccaggcgaacatagaacaatcacagtggagttttgccctctgaagcggggaagggccacaaacatcgccaccgtgtcttattgcgggggccacaagaacacagccagcgttaccacagtgattaacgagccttgtgtccaggtgtccattgctggagcagattggtcctacgtgtgtaagcctgtggagtacgttatttccgtgagcaatcctggcgacctggtgctgagagacgtggttgtggaagatacactgagccctggagtgaccgtgctggaagcagccggagcacagatctcctgcaataaggttgtttggaccgtgaaggagctgaacccaggcgagtcactgcagtataaggtactggtgagagcacagacaccaggccagtttactaacaatgtggtggtgaaatcctgctccgattgcgggacatgtacctcctgtgccgaagcaaccacatactggaaaggggtggccgccactcatatgtgcgtggtggacacatgcgatcctgtgtgcgtcggcgagaacactgtgtaccgaatctgcgtgacaaatcggggaagcgccgaagatacaaacgtctccctgatgctgaagttcagcaaggagctgcagccagtgagctttagcgggcccactaaaggcactattacaggcaataccgtggtgtttgattctctgcctcggctggggtctaaggagactgtggagttctccgtgactctgaaggctgtgtctgctggcgatgcaaggggagaagcaattctgagctccgacaccctgacagtgcccgtgagcgacactgaaaatacacatatctacggctcctctcaccatcaccaccatcaccatcatggagggtctggaggctctggaggatctgcatggagccacccccagtttgaaaagtaa

SEQ ID NO: 439 - RNA, 1698 nt, synthetic construct
  source 1..1698: mol_type = other RNA
atgaaggccaagctcctggtcctgctgtgtactttcaccgctacctatgccgatacaatcgagtcactgagcaccaatgtgattagcctggcagacactaaagccaaggacaacacttcccacaagagcaagaaggctagaaaaaatcacagcaaggagactctggtggacaggaaggaggttgctccagtgcacgagagtaaggccaccgggcccaaacaggactcctgctttggacggatgtacacagtcaaggtgaatgacgatcgcaatgtagaaattacccaggccgtgccagagtatgccaccgtggggtccccatacccaattgagattaccgccactggaaagcgggattgcgtggatgtcattattacacagcagctgccttgtgaggccgagttcgtgaggtctgatcctgcaacaacacctactgctgacgggaagctggtctggaagattgatagactgggccagggagaaaaatctaagatcaccgtgtgggtgaagccactgaaggagggctgctgctttacagcagccactgtgtgtgcttgccctgagattaggtctgtgacaaaatgcggccagcctgccatttgtgtgaagcaggaagggcctgaaaatgcctgcctgcgctgccctgttgtgtacaagattaatgtggtgaatcagggcactgcaattgctcggaacgtcgtggtggagaacccagtgcccgatggatatgctcactccagtgggcagcgggtcctgacattcaccctgggggacatgcagcctggagagcatagaacaatcaccgtggaattttgtcccctgaaaagggggagggcaacaaatattgcaaccgtgtcttactgtggcggacacaagaacacagctagcgttaccactgtgatcaacgagccttgcgtgcaggtgtctatcgctggcgctgactggagctatgtctgcaagcctgtggaatatgtcatctccgtgtccaacccaggggacctggtgctgagagatgtggtcgtggaagacactctgtcccctggcgtgacagtgctggaagcagcaggggcccagattagctgtaacaaggtggtgtggaccgtcaaggagctgaatccaggagagtctctgcagtataaggtgttagtgagagctcagactccaggacagtttaccaacaacgtggtcgtgaaatcctgtagtgattgcggcacatgtacatcttgtgccgaagctaccacatactggaaaggagtggccgctacccacatgtgtgtcgtcgacacctgtgaccctgtgtgtgtcggcgaaaatacagtgtacagaatttgtgtgactaatagaggcagcgccgaagacactaacgttagcctgatgctgaaattcagcaaggagctgcagcccgtgtccttctctgggccaacaaagggcacaattaccggcaatactgtggtgtttgactccctgcctaggctgggcagcaaggagactgttgagtttagtgtgactctgaaagccgtgtccgctggagatgcccggggggaagcaatcctgtccagcgataccctgaccgtcccagttagcgacacagagaatactcatatctacggctcctctcaccatcaccaccatcaccatcatggagggtctggaggctctggaggatctgcatggagccacccccagtttgaaaagtaa

SEQ ID NO: 440 - RNA, 639 nt, synthetic construct
  source 1..639: mol_type = other RNA
atgacaaccaagcccaagactctggagattgataataacacattcctgctgctggaggggaacctgaagagaatcttcgcaacccccattggctatacaacattcagagagtttcagaacgtggtgttcaactgcgcccaggggcaacaggaactggccaacttcctgttcgagatgctgattaacggaaagctgctgcaggagctgcctgccggacagaaacagtctgcccagtccctgatcgtgcagttcatgatgcccatcagagtggcaaaggacattcacgagcgcggcgagttcattaatttcatcacctccgacatgctggctcagcaggaaagatgcgtgtttctcaatagactgagcagggtggacggccaggagttcctgctgatgaccgacgtgcagaacacatgccacctgatcagacacctcctgtctcggctgctggaggcccagaagaaccccatcggagagaagaatctccaggagatccaggaggatctggattctctgagagcacacttcgaggagctcaccaagtccgtgggatcttcccatcaccatcatcaccatcaccacggaggatctggcggatccggaggatctgcctggagccacccacagttcgagaagtaa

SEQ ID NO: 441 - RNA, 552 nt, synthetic construct
  source 1..552: mol_type = other RNA
atgaccaccaaacccaagacactggagattgataataacactttcctgctgctggagggcaatctgaagagaatctttgccactcccatcggatatacaacctttcgggagttccagaacgtggtgtttaactgcgctcagggccagcaggagctggctaactttctcttcgaaatgctgatcaacggcaagctgctgcaggagctccccgctgggcagaagcagtctgcccagtctctgatcgtgcagtttatgatgccaatcagagtggctaaggacatccatgagaggggcgaattcatcaacttcatcacatccgatatgctggctcagcaggagaggtgcgtgttcctgaacaggctgtctcgggtcgatggccaggagtttctgctgatgaccgacgtgcagaacacatgtcacctgatcaggcacctcctgtccaggctcctggaggcccagaaaaaccccatcggagagaagaacctgcaagagatccaggaggacctggatagcctgagggcacactttgaggagctgactaagtccgtgtaa

SEQ ID NO: 442 - RNA, 690 nt, synthetic construct
  source 1..690: mol_type = other RNA
atgaaggccaagctcctggtcctgctgtgtactttcaccgctacctatgccgacaccactaaacccaagactctggagatcgataataatacattcctgctgcttgagggaaacctgaagagaatctttgccacccccatcggatataccactttccgggagttccagaacgtggtcttcaactgtgcccagggccagcaggagctcgcaaactttctcttcgaaatgctgatcaacggcaagctgctgcaggagctgccagctggacagaaacagtccgcccaatccctgatcgtgcagtttatgatgccaatccgggtggcaaaggacattcacgagagaggagaattcattaactttatcacctccgacatgctggcacagcaggagcgctgcgtgttcctgaatcgcctgtctcgggtggatggccaggaattcctgctgatgactgatgtccagaatacctgccacctcattaggcacctcctgagcagactgctggaagcacagaagaaccccattggagagaagaacctgcaggagatccaggaggacctggatagcctgcgggcacattttgaagaactgacaaagagcgtcggctcctctcaccatcaccaccatcaccatcatggagggtctggaggctctggaggatctgcatggagccacccccagtttgaaaagtaa

SEQ ID NO: 443-451 - skipped (9 entries)

SEQ ID NO: 452 - RNA, 1224 nt, synthetic construct
  source 1..1224: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 453 - RNA, 1224 nt, synthetic construct
  source 1..1224: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 454 - RNA, 1242 nt, synthetic construct
  source 1..1242: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 455 - RNA, 1197 nt, synthetic construct
  source 1..1197: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 456 - RNA, 1152 nt, synthetic construct
  source 1..1152: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 457 - RNA, 1128 nt, synthetic construct
  source 1..1128: mol_type = other RNA
atgaagaagctgctgaagtccgtgctggtgttcgctgccctgtcttccgctagctctctgcaggcactgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 458 - RNA, 1128 nt, synthetic construct
  source 1..1128: mol_type = other RNA
atgaaaaagctgctgaagtctgtgctggtgttcgccgctctgtcctctgcttcctccctgcaagccctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatggggggcggaggaggcgggaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgacaatgagaaccagagcacagtcaaaaccaactccgtgcccaatatgtccctggatcagagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggggcggaggaggcgggacaggcacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgggggcggaggaggcggggacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttggatcttcccatcaccatcatcaccatcaccacggaggatctggcggatccggaggatctgcctggagccacccacagttcgagaagtaa

SEQ ID NO: 459-461 - skipped (3 entries)

SEQ ID NO: 462 - protein, 8 aa, synthetic construct
AASSGGAS

SEQ ID NO: 463 - protein, 10 aa, synthetic construct
QPSPQAGPQQ

SEQ ID NO: 464 - protein, 9 aa, synthetic construct
ASGGSGVAL

SEQ ID NO: 465 - protein, 10 aa, synthetic construct
GASGAGSAAQ

SEQ ID NO: 466 - protein, 12 aa, synthetic construct
SGGAGAPPGAGA

SEQ ID NO: 467 - protein, 11 aa, synthetic construct
PQSGAPSGPQP

SEQ ID NO: 468 - protein, 13 aa, synthetic construct
SVALGPSSAGVAL

SEQ ID NO: 469 - protein, 7 aa, synthetic construct
GASASPA

SEQ ID NO: 470 - protein, 371 aa, synthetic construct
LPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 471 - protein, 371 aa, synthetic construct
LPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSSGIAVGTTIVDADKYAVTVETRLIDERAAHVNAQFRF

SEQ ID NO: 472 - protein, 371 aa, synthetic construct
LPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMAFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSCGIAVGTTIVDADKYAVTVETRLIDERAAHVNAQFRF

SEQ ID NO: 473 - protein, 371 aa, synthetic construct
LPVGNPAEPSLMIDGILWEGFGGDPSDPSATWSDAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMAFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPAIAGAGDVKTGAEGQLGDTMQIVSLQLNKMKSRKSSGIAVGTTIVDADKYAVTVETRLIDERAAHVNAQFRF

SEQ ID NO: 474 - protein, 371 aa, synthetic construct
LPVGNPAEPSLMIDGILWEGFGGDPCDPCTTWCDAISMRMGYYGDFVFDRVLKTDVNKEFQMGDKPTSTTGNATAPTTLTARENPAYGRHMQDAEMFTNAACMALNIWDRFDVFCTLGASSGYLKGNSASFNLVGLFGDNENQSTVKTNSVPNMSLDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSCGIAVGTTIVDADKYAVTVETRLIDERAAHVNAQFRF

SEQ ID NO: 475 - protein, 371 aa, synthetic construct
LPVGNPAEPSLMIDGILWEGFGGDPSDPSTTWSDAISMRMGYYGDFVFDRVLKTDVNKEFQMGDKPTSTTGNATAPTTLTARENPAYGRHMQDAEMFTNAASMALNIWDRFDVFSTLGASSGYLKGNSASFNLVGLFGDNENQSTVKTNSVPNMSLDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPTIAGAGDVKASAEGQLGDTMQIVSLQLNKMKSRKSSGIAVGTTIVDADKYAVTVETRLIDERAAHVNAQFRF

SEQ ID NO: 476 - protein, 371 aa, synthetic construct
LPVGNPAEPSLMIDGILWEGFGGDPCDPCTTWCDAISMRMGYYGDFVFDRVLKTDVNKEFQMGDKPTSTTGAATAPTTLTARENPAYGRHMQDAEMFTNAACMALNIWDRFDVFCTLGASSGYLKGNSASFNLVGLFGDNENQATVKTNSVPNMALDQSVVELYTDTAFSWSVGARAALWECGCATLGASFQYAQSKPKVEELNVLCNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSCGIAVGTTIVDADKYAVTVETRLIDERAAHVNAQFRF

SEQ ID NO: 477 - protein, 371 aa, synthetic construct
LPVGNPAEPSLMIDGILWEGFGGDPSDPSTTWSDAISMRMGYYGDFVFDRVLKTDVNKEFQMGDKPTSTTGAATAPTTLTARENPAYGRHMQDAEMFTNAASMALNIWDRFDVFSTLGASSGYLKGNSASFNLVGLFGDNENQATVKTNSVPNMALDQSVVELYTDTAFSWSVGARAALWESGSATLGASFQYAQSKPKVEELNVLSNAAEFTINKPKGYVGQEFPLALIAGTDAATGTKDASIDYHEWQASLALSYRLNMFTPYIGVKWSRASFDADTIRIAQPKSATAIFDTTTLNPAIAGAGDVKASAEGQLGDTMQIVSLQLNKMKSRKSSGIAVGTTIVDADKYAVTVETRLIDERAAHVNAQFRF

SEQ ID NO: 478 - protein, 373 aa, synthetic construct
LPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMTLNIWDRFDVFCTLGATSGYLKGNSASFNLVGLFGDGVNATKPAADSIPNVQLNQSVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGCGSVAGANTEGQISDTMQIVSLQLNKMKSRKSCGIAVGTTIVDADKYAVTVETRLIDERAAHVNAQFRF

SEQ ID NO: 479 - protein, 373 aa, synthetic construct
LPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMTLNIWDRFDVFSTLGATSGYLKGNSASFNLVGLFGDGVNATKPAADSIPNVQLNQSVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPTIAGSGSVAGANTEGQISDTMQIVSLQLNKMKSRKSSGIAVGTTIVDADKYAVTVETRLIDERAAHVNAQFRF

SEQ ID NO: 480 - protein, 373 aa, synthetic construct
LPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMTLNIWDRFDVFCTLGATSGYLKGNSASFNLVGLFGDGVAATKPAADSIPNVQLNQAVVELYTDTTFAWSVGARAALWECGCATLGASFQYAQSKPKIEELNVLCNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGCGSVAGANTEGQISDTMQIVSLQLNKMKSRKSCGIAVGTTIVDADKYAVTVETRLIDERAAHVNAQFRF

SEQ ID NO: 481 - protein, 373 aa, synthetic construct
LPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMTLNIWDRFDVFSTLGATSGYLKGNSASFNLVGLFGDGVAATKPAADSIPNVQLNQAVVELYTDTTFAWSVGARAALWESGSATLGASFQYAQSKPKIEELNVLSNAAEFTINKPKGYVGKEFPLDLTAGTDAATGTKDASIDYHEWQASLSLSYRLNMFTPYIGVKWSRASFDSDTIRIAQPRLVTPVVDITTLNPAIAGSGSVAGANTEGQISDTMQIVSLQLNKMKSRKSSGIAVGTTIVDADKYAVTVETRLIDERAAHVNAQFRF

SEQ ID NO: 482 - protein, 373 aa, synthetic construct
LPVGNPAEPSLMIDGILWEGFGGDPCDPCTTWCDAISMRMGYYGDFVFDRVLKTDVNKEFEMGEALAGASGNTTSTLSKLVERTNPAYGKHMQDAEMFTNAACMALNIWDRFDVFCTLGATSGYLRGNSASFNLVGLFGDSENATQPAATSIPNVQLNQSVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPTIAGCGSVVAANTEGQISDTMQIVSLQLNKMKSRKSCGIAVGTTIVDADKYAVTVETRLIDERAAHVNAQFRF

SEQ ID NO: 483 - protein, 373 aa, synthetic construct
LPVGNPAEPSLMIDGILWEGFGGDPSDPSTTWSDAISMRMGYYGDFVFDRVLKTDVNKEFEMGEALAGASGNTTSTLSKLVERTNPAYGKHMQDAEMFTNAASMALNIWDRFDVFSTLGATSGYLRGNSASFNLVGLFGDSENATQPAATSIPNVQLNQSVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPTIAGSGSVVAANTEGQISDTMQIVSLQLNKMKSRKSSGIAVGTTIVDADKYAVTVETRLIDERAAHVNAQFRF

SEQ ID NO: 484 - protein, 373 aa, synthetic construct
LPVGNPAEPSLMIDGILWEGFGGDPCDPCTTWCDAISMRMGYYGDFVFDRVLKTDVNKEFEMGEALAGASGNTASTLSKLVERTNPAYGKHMQDAEMFTNAACMALNIWDRFDVFCTLGATSGYLRGNSASFNLVGLFGDSEAATQPAATSIPNVQLNQAVVELYTDTAFAWSVGARAALWECGCATLGASFQYAQSKPKVEELNVLCNAAQFTINKPKGYVGQEFPLALTAGTDAATGTKDASIDYHEWQASLSLSYRLNMFTPYIGVKWSRASFDSNTIRIAQPKLAKPVVDITTLNPAIAGCGSVVAANTEGQISDTMQIVSLQLNKMKSRKSCGIAVGTTIVDADKYAVTVETRLIDERAAHVNAQFRF

SEQ ID NO: 485 - protein, 373 aa, synthetic construct
LPVGNPAEPSLMIDGILWEGFGGDPSDPSTTWSDAISMRMGYYGDFVFDRVLKTDVNKEFEMGEALAGASGNTASTLSKLVERTNPAYGKHMQDAEMFTNAASMALNIWDRFDVFSTLGATSGYLRGNSASFNLVGLFGDSEAATQPAATSIPNVQLNQAVVELYTDTAFAWSVGARAALWESGSATLGASFQYAQSKPKVEELNVLSNAAQFTINKPKGYVGQEFPLALTAGTDAATGTKDASIDYHEWQASLSLSYRLNMFTPYIGVKWSRASFDSNTIRIAQPKLAKPVVDITTLNPAIAGSGSVVAANTEGQISDTMQIVSLQLNKMKSRKSSGIAVGTTIVDADKYAVTVETRLIDERAAHVNAQFRF

SEQ ID NO: 486 - protein, 321 aa, synthetic construct
LPVGNPAEPSLMIDGILWEGFGGDPCDPCTTWCDAISMRMGYYGDFVFDRVLKTDVNKEFQMGAASSGGASNPAYGRHMQDAEMFTNAACMALNIWDRFDVFCTLGASSGYLKGNSASFNLVGLFGQPSPQAGPQQVVELYTDTAFSWSVGARAALWECGCATLGASFQYAQSKPKVEELNVLCNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSCGIAVGTTIVDADKYAVTVETRLIDERAAHVNAQFRF

SEQ ID NO: 487 - protein, 321 aa, synthetic construct
LPVGNPAEPSLMIDGILWEGFGGDPSDPSTTWSDAISMRMGYYGDFVFDRVLKTDVNKEFQMGAASSGGASNPAYGRHMQDAEMFTNAASMALNIWDRFDVFSTLGASSGYLKGNSASFNLVGLFGQPSPQAGPQQVVELYTDTAFSWSVGARAALWESGSATLGASFQYAQSKPKVEELNVLSNAAEFTINKPKGYVGASGGSGVALTKDASIDYHEWQASLALSYRLNMFTPYIGVKWSRASFDADTIRIAQPKGASGAGSAAQDTMQIVSLQLNKMKSRKSSGIAVGTTIVDADKYAVTVETRLIDERAAHVNAQFRF

SEQ ID NO: 488 - protein, 328 aa, synthetic construct
LPVGNPAEPSLMIDGILWEGFGGDPCDPCTTWCDAISMRMGYYGDFVFDRVLKTDVNKEFQMGSGGAGAPPGAGANPAYGRHMQDAEMFTNAACMALNIWDRFDVFCTLGASSGYLKGNSASFNLVGLFGPQSGAPSGPQPVVELYTDTAFSWSVGARAALWECGCATLGASFQYAQSKPKVEELNVLCNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSCGIAVGTTIVDADKYAVTVETRLIDERAAHVNAQFRF

SEQ ID NO: 489 - protein, 328 aa, synthetic construct
LPVGNPAEPSLMIDGILWEGFGGDPSDPSTTWSDAISMRMGYYGDFVFDRVLKTDVNKEFQMGSGGAGAPPGAGANPAYGRHMQDAEMFTNAASMALNIWDRFDVFSTLGASSGYLKGNSASFNLVGLFGPQSGAPSGPQPVVELYTDTAFSWSVGARAALWESGSATLGASFQYAQSKPKVEELNVLSNAAEFTINKPKGYVGSVALGPSSAGVALTKDASIDYHEWQASLALSYRLNMFTPYIGVKWSRASFDADTIRIAQPKGASASPAGDTMQIVSLQLNKMKSRKSSGIAVGTTIVDADKYAVTVETRLIDERAAHVNAQFRF

SEQ ID NO: 490 - protein, 392 aa, synthetic construct
ISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLN

SEQ ID NO: 491 - protein, 392 aa, synthetic construct
ISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLN

SEQ ID NO: 492 - protein, 421 aa, synthetic construct
ISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTTSTLSKLVERTNPAYGKHMQDASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQNMFTPYIGVKWSRASFDADTIRIAQPKSATAIFDTTTLNPTIAGAGDVKASAEGQLGDTMQIVSLQLNNMFTPYIGVKWSRASFDSNTIRIAQPKLAKPVVDITTLNPTIAGCGSVVAANTEGQISDTMQIVSLQLNSGSILAIYSTVASSLVLLVSLGAISFGSG

SEQ ID NO: 493 - protein, 421 aa, synthetic construct
ISMRVGYYGDFVFDRVLKTDVNKEFQMGAKPTTDTGNSAAPSTLTARENPAYGRHMQDISMRMGYYGDFVFDRVLKTDVNKEFEMGEALAGASGNTASTLSKLVERTNPAYGKHMQDASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQNMFTPYIGVKWSRASFDADTIRIAQPKSATAIFDTTTLNPAIAGAGDVKASAEGQLGDTMQIVSLQLNNMFTPYIGVKWSRASFDSNTIRIAQPKLAKPVVDITTLNPAIAGCGSVVAANTEGQISDTMQIVSLQLNSGSILAIYSTVASSLVLLVSLGAISFGSG

SEQ ID NO: 494 - protein, 364 aa, synthetic construct
ISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQ

SEQ ID NO: 495 - protein, 364 aa, synthetic construct
ISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQ

SEQ ID NO: 496 - protein, 393 aa, synthetic construct
ISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIASSGYLKGNSASFNLVGLFGDNENQSTVKTNSVPNMSLDQSVVELYTDTATSGYLKGNSASFNLVGLFGDGVNATKPAADSIPNVQLNQSVVELYTDTEFTINKPKGYVGQEFPLALTAGTDAATGTKDASIDYHEWQRIAQPKSATAIFDTTTLNPTIAGAGDVKASAEGQLGDTMQRIAQPKLAKPVVDITTLNPTIAGCGSVVAANTEGQISDTMQSGSILAIYSTVASSLVLLVSLGAISFGSG

SEQ ID NO: 497 - protein, 393 aa, synthetic construct
ISMRVGYYGDFVFDRVLKTDVNKEFQMGAKPTTDTGNSAAPSTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIASSGYLKGNSASFNLVGLFGDNENQATVKTNSVPNMALDQSVVELYTDTATSGYLKGNSASFNLVGLFGDGVAATKPAADSIPNVQLNQAVVELYTDTEFTINKPKGYVGQEFPLALTAGTDAATGTKDASIDYHEWQRIAQPKSATAIFDTTTLNPAIAGAGDVKASAEGQLGDTMQRIAQPKLAKPVVDITTLNPAIAGCGSVVAANTEGQISDTMQSGSILAIYSTVASSLVLLVSLGAISFGSG

SEQ ID NO: 498 - protein, 392 aa, synthetic construct
ISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLN

SEQ ID NO: 499 - protein, 392 aa, synthetic construct
ISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLN

SEQ ID NO: 500 - protein, 421 aa, synthetic construct
ISMRMGYYGDFVFDRVLKTDVNKEFQMGDKPTSTTGNATAPTTLTARENPAYGRHMQDISMRMGYYGDFVFDRVLKTDVNKEFEMGEALAGASGNTTSTLSKLVERTNPAYGKHMQDATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQNMFTPYIGVKWSRASFDADTIRIAQPKSATAIFDTTTLNPTIAGAGDVKTGAEGQLGDTMQIVSLQLNNMFTPYIGVKWSRASFDSDTIRIAQPRLVTPVVDITTLNPTIAGCGSVAGANTEGQISDTMQIVSLQLNSGSILAIYSTVASSLVLLVSLGAISFGSG

SEQ ID NO: 501 - protein, 421 aa, synthetic construct
ISMRMGYYGDFVFDRVLKTDVNKEFQMGDKPTSTTGAATAPTTLTARENPAYGRHMQDISMRMGYYGDFVFDRVLKTDVNKEFEMGEALAGASGNTASTLSKLVERTNPAYGKHMQDATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQNMFTPYIGVKWSRASFDADTIRIAQPKSATAIFDTTTLNPAIAGAGDVKTGAEGQLGDTMQIVSLQLNNMFTPYIGVKWSRASFDSDTIRIAQPRLVTPVVDITTLNPAIAGCGSVAGANTEGQISDTMQIVSLQLNSGSILAIYSTVASSLVLLVSLGAISFGSG

SEQ ID NO: 502 - protein, 364 aa, synthetic construct
ISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQ

SEQ ID NO: 503 - protein, 364 aa, synthetic construct
ISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQ

SEQ ID NO: 504 - protein, 393 aa, synthetic construct
ISMRMGYYGDFVFDRVLKTDVNKEFQMGDKPTSTTGNATAPTTLTARENPAYGRHMQDAEMFTNAACMALNIISMRMGYYGDFVFDRVLKTDVNKEFEMGEALAGASGNTTSTLSKLVERTNPAYGKHMQDAEMFTNAACMTLNIATSGYLKGNSASFNLVGLFGDNENQKTVKAESVPNMSFDQSVVELYTDTATSGYLRGNSASFNLVGLFGDSENATQPAATSIPNVQLNQSVVELYTDTEFTINKPKGYVGKEFPLDLTAGTDAATGTKDASIDYHEWQRIAQPKSATAIFDTTTLNPTIAGAGDVKTGAEGQLGDTMQRIAQPRLVTPVVDITTLNPTIAGCGSVAGANTEGQISDTMQSGSILAIYSTVASSLVLLVSLGAISFGSG

SEQ ID NO: 505 - protein, 393 aa, synthetic construct
ISMRMGYYGDFVFDRVLKTDVNKEFQMGDKPTSTTGAATAPTTLTARENPAYGRHMQDAEMFTNAACMALNIISMRMGYYGDFVFDRVLKTDVNKEFEMGEALAGASGNTASTLSKLVERTNPAYGKHMQDAEMFTNAACMTLNIATSGYLKGNSASFNLVGLFGDNENQKTVKAESVPNMAFDQSVVELYTDTATSGYLRGNSASFNLVGLFGDSEAATQPAATSIPNVQLNQAVVELYTDTEFTINKPKGYVGKEFPLDLTAGTDAATGTKDASIDYHEWQRIAQPKSATAIFDTTTLNPAIAGAGDVKTGAEGQLGDTMQRIAQPRLVTPVVDITTLNPAIAGCGSVAGANTEGQISDTMQSGSILAIYSTVASSLVLLVSLGAISFGSG

SEQ ID NO: 506 - protein, 274 aa, synthetic construct
NMFTPYIGVKWSRSAFDSDTIRIAQPKSATAIFDTTTLNPTIAGAGDVKTGAEGQLGDTMQIVSLQLNNMFTPYIGVKWSRSAFDSDTIRIAQPKSATAIFDTTTLNPTIAGAGDVKASAEGQLGDTMQIVSLQLNNMFTPYIGVKWSRSAFDSDTIRIAQPRLVTPVVDITTLNPTIAGSGSVAGANTEFQISDTMQIVSLQLNNMFTPYIGVKWSRASFDSNTIRIAQPKLAKPVVDITTLNPTIAGSGSVVAANSEGQISDTMQIVSLQLN

SEQ ID NO: 507 - protein, 516 aa, synthetic construct
ESLSTNVISLADTKAKDNTSHKSKKARKNHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 508 - protein, 516 aa, synthetic construct
ESLSTNVISLADTKAKDQTSHKSKKARKQHSKETLVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTAIARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTQVSLMLKFSKELQPVSFSGPTKGTITGNTVVFDSLPRLGSKETVEFSVTLKAVSAGDARGEAILSSDTLTVPVSDTENTHIY

SEQ ID NO: 509 - protein, 182 aa, synthetic construct
TTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 510 - protein, 182 aa, synthetic construct
TTKPKTLEIDQNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 511 - protein, 182 aa, synthetic construct
TTKPKTLEIDNNTFLLLEGNLKRIFATPIGYTTFREFQNVVFNSAQGQQELANFLFEMLINGKLLQELPAGQKQSAQSLIVQFMMPIRVAKDIHERGEFINFITSDMLAQQERSVFLNRLSRVDGQEFLLMTDVQNTSHLIRHLLSRLLEAQKNPIGEKNLQEIQEDLDSLRAHFEELTKSV

SEQ ID NO: 512 - protein, 182 aa, synthetic construct
TTKPKTLEIDQNTFLLLEGNLKRIFATPIGYTTFREFQNVVFNSAQGQQELANFLFEMLINGKLLQELPAGQKQSAQSLIVQFMMPIRVAKDIHERGEFINFITSDMLAQQERSVFLNRLSRVDGQEFLLMTDVQNTSHLIRHLLSRLLEAQKNPIGEKNLQEIQEDLDSLRAHFEELTKSV

SEQ ID NO: 513 - protein, 155 aa, synthetic construct
DSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 514 - protein, 155 aa, synthetic construct
DSARPRKSSFGFVPFYSDEEIQQAFVEDFDSKEEQLYKTSAQSTSFRQITFATDSYSIKGEDNLAILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 515 - protein, 1499 aa, synthetic construct
CVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGSASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTASKLGYEANAGLRLIF

SEQ ID NO: 516 - protein, 952 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 517 - protein, 952 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 518 - protein, 1128 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 519 - protein, 1128 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 520 - protein, 952 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 521 - protein, 952 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 522 - protein, 952 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 523 - protein, 952 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKIL

SEQ ID NO: 524 - protein, 952 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 525 - protein, 952 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 526 - protein, 952 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 527 - protein, 952 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKIL

SEQ ID NO: 528 - protein, 1128 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 529 - protein, 1128 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 530 - protein, 1128 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 531 - protein, 1128 aa, synthetic construct
SSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 532 - protein, 1128 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 533 - protein, 1128 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGTAEQSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 534 - protein, 1128 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSDELAKRRESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 535 - protein, 1128 aa, synthetic construct
SSFQEKDADTLPGKVEQSTLFSVTNPVVFQGVDQQDQVSSQGLISSFTSSNLDSPRDGESFLGIAFVGDSSKAGITLTDVKASLSGAALYSTEDLIFEKIKGGLEFASCSSLEQGGASAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNSAELVFKGNSAIGTEDKGSLGGGAISSLGTVLLQGNHGITSDKNESASQGGAIFGKNSQISDNEGPVVFRDSTASLGGGAIAAQEIVSIQNNQAGISFEGGKASFGGGIASESFSSAGGASVLGAIDISKNLGAISFSRTLSTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQSSEEEATLLGSSGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAENSFITAANQALFASEDGDLSPESSISSEELAKRKESAGGAIFAKRVRIVDNQEAVVFSNNFSDIYGGAIFTGSLREEDKLDGQIPEVLISGNAGDVVFSGNSSKRDEHLPHTGGGAISTQNLTISQNTGNVLFYNNVASSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQSIHVQQGSLELLNGATLSSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKA

SEQ ID NO: 536 - DNA, 609 bp, synthetic construct
  source 1..609: mol_type = other DNA
atgggcagcagccatcatcatcatcatcacagcagcggcctggtgccgcgcggcagccatatgacgacgaagccgaagaccctggaaatcgacaataacacgtttctgctgctggaaggtaatctgaagcgcatttttgccaccccgattggctataccacgtttcgtgaattccagaacgtggtttttaattgcgcacagggtcagcaagaactggctaactttctgttcgaaatgctgattaatggcaaactgctgcaggaactgccggcgggtcagaagcaaagcgcccagtctctgatcgtccaattcatgatgccgattcgtgtggcgaaagatatccatgaacgcggcgaatttattaacttcatcaccagtgacatgctggcccagcaagaacgctgcgtttttctgaatcgtctgtcccgcgtcgatggtcaggaattcctgctgatgaccgacgtgcaaaacacgtgtcatctgattcgtcacctgctgagccgcctgctggaagcgcagaaaaacccgatcggcgaaaagaatctgcaggaaatccaagaagacctggacagcctgcgtgcccactttgaagaactgacgaagagcgtg

SEQ ID NO: 537 - DNA, 534 bp, synthetic construct
  source 1..534: mol_type = other DNA
atgggcagcagccatcatcatcatcatcacagcagcggcctggtgccgcgcggcagccatatggatagtgctcgcccgcgtaaatctagctttggttttgtcccgttttattcagacgaagaaattcaacaggcttttgtggaagactttgatagcaaagaagaacagctgtataaaacctctgcccaaagcacgtcttttcgtaacattaccttcgcaacggatagttactccattaaaggcgaagacaatctgaccatcctggcttcactggtccgtcatctgcacaaatcgccgaaagcgaccctgtatatcgaaggtcacacggatgaacgtggtgcagcagcatacaacctggctctgggtgcacgtcgcgcaaatgcagtgaaacagtatctgattaaacaaggtatcgctgcggaccgtctgtttaccatttcctacggcaaagaacatccggttcacccgggtcataacgaactggcctggcagcaaaatcgtcgcacggaattcaaaatccatgcgcgctaatga

SEQ ID NO: 538 - DNA, 1581 bp, synthetic construct
  source 1..1581: mol_type = other DNA
atggaaagtctatctacaaatgtaatatcactggctgacaccaaggcgaaagataatacttctcacaaaagcaagaaagctcgcaagaaccatagcaaggaaactttggttgaccgtaaagaagttgcaccggtgcatgaatccaaggcgacgggtccgaaacaggatagctgcttcggccgtatgtataccgtcaaggtgaacgatgatcgcaacgtcgaaatcacccaagcagtgccggaatacgcgaccgtaggttcaccgtatccgattgaaatcacggccaccggcaaacgcgactgtgtggacgtgatcatcacgcagcagctgccgtgtgaagcggagttcgttcgttccgacccggctacaaccccgactgccgacggcaaactggtgtggaaaatcgatcgtctgggccaaggtgagaagtccaagatcaccgtttgggttaagccgctgaaggagggttgttgctttaccgcggcaaccgtgtgcgcgtgcccggagatccgcagtgtgaccaaatgcggtcagccggcgatctgcgtgaaacaagaaggtcccgagaacgcgtgcctgcgttgtccggttgtctacaagatcaacgtagtgaatcagggcaccgcgatcgcgcgtaatgtggtggtcgagaacccggtgccagatggttatgcacattctagcggtcaaagagttttgacctttaccctgggcgacatgcagccgggcgagcaccgtaccatcacggttgaattttgtccgctgaagcgcggtcgtgcaacgaacattgcgactgtatcctactgcggtggtcataaaaacaccgctagcgttaccaccgtgattaatgaaccgtgcgttcaggtttcaattgcgggtgctgactggagctatgtttgtaaaccggtcgagtacgttatcagcgttagcaatccgggagacctggttttacgtgatgttgtggtagaggataccttgtctccgggcgttactgttctggaagccgcgggtgcgcagattagctgcaacaaagttgtttggaccgtgaaagagttgaatccgggtgagagcctgcaatataaagttttggtgcgtgcgcagaccccaggccaatttacgaacaacgtggtggttaaatcttgcagcgactgtggcacctgcactagctgcgcggaagccacgacgtactggaaaggtgtggctgccacccacatgtgtgtcgtcgacacgtgcgacccggtgtgcgttggtgagaacaccgtgtaccgcatttgcgtgaccaaccgtggctctgcagaagataccaatgtttcccttatgctgaagttcagcaaggagctgcagcctgtctcgttcagcggcccaaccaaaggcaccattaccggtaataccgtcgtctttgatagcttaccgcgtctgggttccaaggagacagttgagttcagcgttaccctcaaggccgtttctgcgggggatgcaagaggcgaggcaattctgagcagcgacaccctgaccgtcccggtgtcggacacggaaaacacccatatttacggcggttcccatcaccaccaccaccactaa

SEQ ID NO: 539 - RNA, 828 nt, synthetic construct
  source 1..828: mol_type = other RNA
aacatgttcactccatatattggcgtcaaatggtcccggagcgcattcgacagcgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctaccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactgatga

SEQ ID NO: 540 - RNA, 828 nt, synthetic construct
  source 1..828: mol_type = other RNA
aacatgtttacaccttacatcggggtgaagtggagcagatccgccttcgactcagatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctacaattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaattgatga

SEQ ID NO: 541 - RNA, 915 nt, synthetic construct
  source 1..915: mol_type = other RNA
aacatgttcactccatatattggcgtcaaatggtcccggagcgcattcgacagcgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctaccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggctgatga

SEQ ID NO: 542 - RNA, 915 nt, synthetic construct
  source 1..915: mol_type = other RNA
aacatgtttacaccttacatcggggtgaagtggagcagatccgccttcgactcagatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctacaattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggctgatga

SEQ ID NO: 543 - RNA, 828 nt, synthetic construct
  source 1..828: mol_type = other RNA
aacatgttcactccatatattggcgtcaaatggtcccggagcgcattcgacagcgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctgccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactgatga

SEQ ID NO: 544 - RNA, 828 nt, synthetic construct
  source 1..828: mol_type = other RNA
aacatgtttacaccttacatcggggtgaagtggagcagatccgccttcgactcagatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctgccattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaattgatga

SEQ ID NO: 545 - RNA, 915 nt, synthetic construct
  source 1..915: mol_type = other RNA
aacatgttcactccatatattggcgtcaaatggtcccggagcgcattcgacagcgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctgccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggctgatga

SEQ ID NO: 546 - RNA, 915 nt, synthetic construct
  source 1..915: mol_type = other RNA
aacatgtttacaccttacatcggggtgaagtggagcagatccgccttcgactcagatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctaggagcgctttcgatagcgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcggagcgcattcgattctgacacaatccggatcgcccaaccaagactggttacacccgtcgtggacatcacaactctgaatcctgccattgctggcagcgggagcgtggcaggcgcaaatactgaatttcagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggctgatga

SEQ ID NO: 547 - RNA, 1506 nt, synthetic construct
  source 1..1506: mol_type = other RNA
gacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatgagctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagaagcgcattcgattctgataccattaggattgctcagccaaaaagcgcaaccgccatttttgatactactactctgaatcccacaattgccggcgcaggcgatgtcaagactggggccgagggacagctgggagatacaatgcagatcgtgtccctgcagctgaacaacatgtttacaccatatattggtgtcaagtggagcaggtccgcatttgattccgatactattagaatcgcccagcccaagtccgccacagcaatctttgacactacaaccctgaaccctaccattgctggcgccggggacgtgaaagcatccgccgaagggcagctgggcgatacaatgcagatcgtctccctgcagctcaataacatgttcaccccttacattggggtgaaatggagcagaagtgcttttgatagtgataccattcggattgctcagccccggctcgtcactcccgtggtggatattaccacactgaaccctactattgctgggagcggctctgtggctggcgctaatacggaattccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccaacaattgccggaagcgggtctgtggtcgccgcaaactctgagggacagatctctgacactatgcagattgtgagcctgcagctgaactgatga

SEQ ID NO: 548 - RNA, 1506 nt, synthetic construct
  source 1..1506: mol_type = other RNA
gacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccgtgaaggccgagtccgtccctaatatgtctttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctaggagcgcttttgactctgatacgattagaattgctcagcctaaaagcgccaccgcaattttcgatactactacactgaacccaaccatcgctggagcaggcgatgtgaagaccggcgcagagggacaactgggcgacactatgcagattgtgagtctgcagctcaataacatgttcactccttatattggggtgaaatggtccagatctgcattcgactctgacaccatcagaattgctcagcccaagtctgctacagccatcttcgacaccactaccctgaacccaactattgctggagccggagacgtcaaagcctcagcagaggggcaactgggcgataccatgcagatcgtgtctctgcagctcaacaacatgtttaccccgtatattggcgtgaagtggtcacggtccgcatttgactctgacacaattagaatcgcccagcctagactggtgacacccgttgttgacatcacaacactgaacccaacaatcgccggatctggcagcgtcgccggcgccaatactgagttccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccaaccattgctggaagcgggtccgtggtggccgcaaatagcgagggccagatttctgacaccatgcagattgtgtccctgcagctgaactgatga

SEQ ID NO: 549 - RNA, 1506 nt, synthetic construct
  source 1..1506: mol_type = other RNA
gacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatggcctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagaagcgcattcgattctgataccattaggattgctcagccaaaaagcgcaaccgccatttttgatactactactctgaatcccgccattgccggcgcaggcgatgtcaagactggggccgagggacagctgggagatacaatgcagatcgtgtccctgcagctgaacaacatgtttacaccatatattggtgtcaagtggagcaggtccgcatttgattccgatactattagaatcgcccagcccaagtccgccacagcaatctttgacactacaaccctgaaccctgccattgctggcgccggggacgtgaaagcatccgccgaagggcagctgggcgatacaatgcagatcgtctccctgcagctcaataacatgttcaccccttacattggggtgaaatggagcagaagtgcttttgatagtgataccattcggattgctcagccccggctcgtcactcccgtggtggatattaccacactgaaccctgccattgctgggagcggctctgtggctggcgctaatacggaattccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccagccattgccggaagcgggtctgtggtcgccgcaaactctgagggacagatctctgacactatgcagattgtgagcctgcagctgaactgatga

SEQ ID NO: 550 - RNA, 1506 nt, synthetic construct; identical to SEQ ID NO: 549
  source 1..1506: mol_type = other RNA

SEQ ID NO: 551 - RNA, 969 nt, synthetic construct
  source 1..969: mol_type = other RNA
ctgcctgtgggcaatcctgctgaaccttctctgatgattgacggaatcctgtgggaaggctttggcggggacccttgcgacccttgtaccacttggtgcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgcttgcatggccctgaacatttgggacagattcgacgtgttttgcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagtgcggatgtgccacactgggcgcctctttccagtatgcacagtctaagcctaaggtggaggagctgaatgtgctgtgcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtcctgtggaatcgccgtgggaaccactatcgtggacgcagacaagtatgctgtgaccgtggagacacgcctgattgatgaacgcgcagcccatgtgaatgcacagttccggttttgatga

SEQ ID NO: 552 - RNA, 969 nt, synthetic construct
  source 1..969: mol_type = other RNA
ctgcctgtggggaatcccgctgagccatctctgatgatcgatgggattctgtgggagggcttcggcggggacccatgcgatccatgtacaacttggtgcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgcctgcatggccctcaacatctgggacaggtttgacgtgttctgcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaatgtggatgcgctactctgggcgctagcttccagtacgcacaaagcaaaccaaaagtcgaggagctgaacgtgctgtgcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatcttgtgggatcgccgtgggaaccacaattgtggacgctgacaaatacgctgtgacagttgaaacccgcctgatcgatgaaagagctgctcacgtgaatgcacagtttaggttttgatga

SEQ ID NO: 553 - RNA, 969 nt, synthetic construct; identical to SEQ ID NO: 551
  source 1..969: mol_type = other RNA

SEQ ID NO: 554 - RNA, 969 nt, synthetic construct; identical to SEQ ID NO: 552
  source 1..969: mol_type = other RNA

SEQ ID NO: 555 - RNA, 969 nt, synthetic construct
  source 1..969: mol_type = other RNA
ctgcctgtgggcaatcctgctgaaccttctctgatgattgacggaatcctgtgggaaggctttggcggggaccctagcgaccctagcaccacttggagcgacgcaatttccatgcggatggggtactacggcgacttcgtgttcgatcgcgtgctgaagaccgatgtgaacaaggagtttcagatgggcgccgcttcatccggaggagcaagcaaccctgcctatggaagacatatgcaggacgctgagatgtttaccaacgccgctagcatggccctgaacatttgggacagattcgacgtgtttagcacactgggagcttccagcggatacctgaaaggaaattccgctagttttaacctggtgggactgttcggacagcctagccctcaggctggacctcagcaggtggtggagctatatacagataccgcattctcctggtccgtgggagctagagccgctctgtgggagagcggaagcgccacactgggcgcctctttccagtatgcacagtctaagcctaaggtggaggagctgaatgtgctgagcaacgccgccgaattcacaatcaacaaaccaaagggctatgtgggggcaagcggaggcagcggggttgcactgaccaaagatgcctccattgattatcatgagtggcaggcatccctcgctctgagctatcggctgaacatgtttactccctacatcggcgtcaagtggagcagagcctctttcgacgccgacacaatcagaattgcccagcctaagggagcttccggagccggctctgcagcccaggacacaatgcagattgtgagcctgcagctgaacaagatgaagtcaaggaagtccagcggaatcgccgtgggaaccactatcgtggacgcagacaagtatgctgtgaccgtggagacacgcctgattgatgaacgcgcagcccatgtgaatgcacagttccggttttgatga

SEQ ID NO: 556 - RNA, 969 nt, synthetic construct
  source 1..969: mol_type = other RNA
ctgcctgtggggaatcccgctgagccatctctgatgatcgatgggattctgtgggagggcttcggcggggacccaagcgatccaagcacaacttggagcgatgctatcagcatgagaatggggtactatggggatttcgtgttcgatagggtgctgaagacagacgtgaataaggaatttcagatgggagcagcctcatccggaggcgcatccaaccctgcatacggcagacacatgcaggatgctgagatgtttacaaatgctgccagcatggccctcaacatctgggacaggtttgacgtgttcagcaccctgggggcctcctctggatatctcaaagggaacagcgccagcttcaacctggtggggctgttcggacaaccaagcccacaggctggaccacagcaggtggttgagctgtatacagacacagctttctcctggtctgtcggagccagagcagccctgtgggaaagcggaagcgctactctgggcgctagcttccagtacgcacaaagcaaaccaaaagtcgaggagctgaacgtgctgagcaatgccgcagagtttaccattaacaagcccaagggctatgtgggagcttccggaggatccggagtggccctgacaaaggacgcctccatcgattaccacgagtggcaggcttctctcgccctgagctacaggctgaacatgtttactccctacattggggtgaagtggtcccgggcttcctttgacgccgatactatccgcatcgctcagccaaaaggggcctctggagccggatccgctgcccaagatacaatgcagatcgtgtccctgcagctgaacaagatgaagtccagaaaatctagcgggatcgccgtgggaaccacaattgtggacgctgacaaatacgctgtgacagttgaaacccgcctgatcgatgaaagagctgctcacgtgaatgcacagtttaggttttgatga

SEQ ID NO: 557 - RNA, 969 nt, synthetic construct; identical to SEQ ID NO: 555
  source 1..969: mol_type = other RNA

SEQ ID NO: 558 - RNA, 969 nt, synthetic construct; identical to SEQ ID NO: 556
  source 1..969: mol_type = other RNA

SEQ ID NO: 559 - RNA, 990 nt, synthetic construct
  source 1..990: mol_type = other RNA
ctgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 560 - RNA, 990 nt, synthetic construct
  source 1..990: mol_type = other RNA
ctgcctgtgggcaatccagccgaaccatccctgatgatcgacggcatcctgtgggaggggttcgggggcgacccttgcgatccctgcacaacctggtgcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgcttgtatggctctcaacatttgggatagatttgacgtgttctgtacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagtgcggatgtgctacactgggcgcatctttccagtatgcccagtccaagccaaaggtggaggagctgaacgtgctgtgtaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtcctgtggcattgccgtgggaacaaccatcgtggacgccgataagtatgctgtgacagtggaaacacggctcatcgacgagagagctgcccacgtgaacgcacagttccggttttgatga

SEQ ID NO: 561 - RNA, 990 nt, synthetic construct; identical to SEQ ID NO: 559
  source 1..990: mol_type = other RNA

SEQ ID NO: 562 - RNA, 990 nt, synthetic construct; identical to SEQ ID NO: 560
  source 1..990: mol_type = other RNA

SEQ ID NO: 563 - RNA, 990 nt, synthetic construct
  source 1..990: mol_type = other RNA
ctgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagatgccagcatcgattaccacgagtggcaggcctctctggccctgtcctatagactgaacatgttcactccttacatcggcgttaaatggagcagagcctcttttgacgccgatacaatccggatcgcccagcctaaaggcgcatctgccagccctgctggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 564 - RNA, 990 nt, synthetic construct
  source 1..990: mol_type = other RNA
ctgcctgtgggcaatccagccgaaccatccctgatgatcgacggcatcctgtgggaggggttcgggggcgaccctagcgatcccagcacaacctggagcgatgcaatctctatgaggatgggctactacggggatttcgtgttcgacagggttctgaagaccgatgttaacaaggagtttcagatggggagtggaggagctggagctccacctggagcaggagcaaaccctgcctatggaagacatatgcaggacgcagagatgtttaccaatgccgctagcatggctctcaacatttgggatagatttgacgtgttcagcacactcggcgcatccagcggctacctgaaggggaactccgcctccttcaacctggtgggcctgttcggccctcaatctggcgccccttcaggacctcagcccgtggttgagctgtacaccgacaccgccttctcttggtctgtgggcgctagggccgcactgtgggagagcggaagcgctacactgggcgcatctttccagtatgcccagtccaagccaaaggtggaggagctgaacgtgctgagcaacgccgccgagttcactatcaacaagcctaaaggctatgtgggcagcgttgcactgggaccatcttctgcaggagtggccctgaccaaagacgcctccattgactaccacgagtggcaggcctccctggccctgagttatcggctcaacatgttcaccccttacattggggtgaagtggtctagggcttccttcgatgcagacactatccgcatcgctcagcctaagggagcctctgcctcccccgccggcgacaccatgcagatcgtgtctctgcagctgaataagatgaaaagccggaagtccagcggcattgccgtgggaacaaccatcgtggacgccgataagtatgctgtgacagtggaaacacggctcatcgacgagagagctgcccacgtgaacgcacagttccggttttgatga

SEQ ID NO: 565 - RNA, 990 nt, synthetic construct; identical to SEQ ID NO: 563
  source 1..990: mol_type = other RNA

SEQ ID NO: 566 - RNA, 990 nt, synthetic construct; identical to SEQ ID NO: 564
  source 1..990: mol_type = other RNA

SEQ ID NO: 567 - RNA, 1182 nt, synthetic construct
  source 1..1182: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactgatga

SEQ ID NO: 568 - RNA, 1182 nt, synthetic construct
  source 1..1182: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaactgatga

SEQ ID NO: 569 - RNA, 1182 nt, synthetic construct
  source 1..1182: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactgatga

SEQ ID NO: 570 - RNA, 1182 nt, synthetic construct
  source 1..1182: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaactgatga

SEQ ID NO: 571 - RNA, 1269 nt, synthetic construct
  source 1..1269: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactccggctccatcctggccatctatagcaccgtggctagcagcctggtgctgctggtgtccctgggagctattagcttcggatctggctgatga

SEQ ID NO: 572 - RNA, 1269 nt, synthetic construct
  source 1..1269: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaacagcggctctattctggccatctacagtactgtggcttcctccctggtgctgctggtgtctctgggcgccatttccttcggctctggctgatga

SEQ ID NO: 573 - RNA, 1269 nt, synthetic construct
  source 1..1269: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactccggctccatcctggccatctatagcaccgtggctagcagcctggtgctgctggtgtccctgggagctattagcttcggatctggctgatga

SEQ ID NO: 574 - RNA, 1269 nt, synthetic construct
  source 1..1269: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaacagcggctctattctggccatctacagtactgtggcttcctccctggtgctgctggtgtctctgggcgccatttccttcggctctggctgatga

SEQ ID NO: 575 - RNA, 1182 nt, synthetic construct; identical to SEQ ID NO: 567
  source 1..1182: mol_type = other RNA

SEQ ID NO: 576 - RNA, 1182 nt, synthetic construct; identical to SEQ ID NO: 568
  source 1..1182: mol_type = other RNA

SEQ ID NO: 577 - RNA, 1182 nt, synthetic construct; identical to SEQ ID NO: 569
  source 1..1182: mol_type = other RNA

SEQ ID NO: 578 - RNA, 1182 nt, synthetic construct; identical to SEQ ID NO: 570
  source 1..1182: mol_type = other RNA

SEQ ID NO: 579 - RNA, 1269 nt, synthetic construct
  source 1..1269: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacaacatctacactgtccaagctggtggagcgcaccaaccctgcctacgggaagcacatgcaggatgcatccagcgggtacctgaagggcaatagcgcctcttttaacctcgtgggcctgtttggagataacgagaaccagagcactgtcaagacaaatagcgtgcctaacatgtccctggaccagagcgtcgtggaactgtacactgacactgccacctctggctacctgaagggaaactccgcttctttcaatcttgtgggactgtttggagacggagtgaatgccaccaagccagcagccgatagcatccccaacgtgcagctgaaccagagcgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctactatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccaactatcgcaggatgcggcagcgtggtggccgctaatactgaaggccagatctccgataccatgcagattgtgtctctgcagctgaactccggctccatcctggccatctatagcaccgtggctagcagcctggtgctggtggtgtccctgggagctattagcttcggatctggctgatga

SEQ ID NO: 580 - RNA, 1269 nt, synthetic construct
  source 1..1269: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaacagcggctctattctggccatctacagtactgtggcttcctccctggtgctggtggtgtctctgggcgccatttccttcggctctggctgatga

SEQ ID NO: 581 - RNA, 1269 nt, synthetic construct
  source 1..1269: mol_type = other RNA
atttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactccggctccatcctggccatctatagcaccgtggctagcagcctggtgctggtggtgtccctgggagctattagcttcggatctggctgatga

SEQ ID NO: 582 - RNA, 1269 nt, synthetic construct
  source 1..1269: mol_type = other RNA
atttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaacagcggctctattctggccatctacagtactgtggcttcctccctggtgctggtggtgtctctgggcgccatttccttcggctctggctgatga

SEQ ID NO: 583 - RNA, 1098 nt, synthetic construct
  source 1..1098: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtgatga

SEQ ID NO: 584 - RNA, 1098 nt, synthetic construct
  source 1..1098: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagtgatga

SEQ ID NO: 585 - RNA, 1098 nt, synthetic construct
  source 1..1098: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtgatga

SEQ ID NO: 586 - RNA, 1098 nt, synthetic construct
  source 1..1098: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagtgatga

SEQ ID NO: 587 - RNA, 1185 nt, synthetic construct
  source 1..1185: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtccggctccatcctggccatctatagcaccgtggctagcagcctggtgctgctggtgtccctgggagctattagcttcggatctggctgatga

SEQ ID NO: 588 - RNA, 1185 nt, synthetic construct
  source 1..1185: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagagcggctctattctggccatctacagtactgtggcttcctccctggtgctgctggtgtctctgggcgccatttccttcggctctggctgatga

SEQ ID NO: 589 - RNA, 1185 nt, synthetic construct
  source 1..1185: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtccggctccatcctggccatctatagcaccgtggctagcagcctggtgctgctggtgtccctgggagctattagcttcggatctggctgatga

SEQ ID NO: 590 - RNA, 1185 nt, synthetic construct
  source 1..1185: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagagcggctctattctggccatctacagtactgtggcttcctccctggtgctgctggtgtctctgggcgccatttccttcggctctggctgatga

SEQ ID NO: 591 - RNA, 1098 nt, synthetic construct; identical to SEQ ID NO: 583
  source 1..1098: mol_type = other RNA

SEQ ID NO: 592 - RNA, 1098 nt, synthetic construct; identical to SEQ ID NO: 584
  source 1..1098: mol_type = other RNA

SEQ ID NO: 593 - RNA, 1098 nt, synthetic construct; identical to SEQ ID NO: 585
  source 1..1098: mol_type = other RNA

SEQ ID NO: 594 - RNA, 1098 nt, synthetic construct; identical to SEQ ID NO: 586
  source 1..1098: mol_type = other RNA

SEQ ID NO: 595 - RNA, 1185 nt, synthetic construct
  source 1..1185: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacaacatccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccagagcactgtcaaaaccaacagcgtgcccaacatgagcctcgaccagtccgtggtggaactgtacacagacactgctacatccggctacctgaaggggaatagcgccagcttcaacctggtgggactgttcggagacggcgtgaacgccaccaaacctgctgctgatagcattccaaacgttcagctgaaccagagcgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccacaattgccggggccggcgacgtgaaggcttccgccgaaggacagctgggggataccatgcagaggatcgcccagcccaagctggccaaacccgtggtggacattacaaccctgaatcccaccattgcaggctgcggctctgtggtggctgccaacactgagggacagatttccgatactatgcagtccggctccatcctggccatctatagcaccgtggctagcagcctggtgctggtggtgtccctgggagctattagcttcggatctggctgatga

SEQ ID NO: 596 - RNA, 1185 nt, synthetic construct
  source 1..1185: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagagcggctctattctggccatctacagtactgtggcttcctccctggtgctggtggtgtctctgggcgccatttccttcggctctggctgatga

SEQ ID NO: 597 - RNA, 1185 nt, synthetic construct
  source 1..1185: mol_type = other RNA
atcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtccggctccatcctggccatctatagcaccgtggctagcagcctggtgctggtggtgtccctgggagctattagcttcggatctggctgatga

SEQ ID NO: 598 - RNA, 1185 nt, synthetic construct
  source 1..1185: mol_type = other RNA
atttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagagcggctctattctggccatctacagtactgtggcttcctccctggtgctggtggtgtctctgggcgccatttccttcggctctggctgatga

SEQ ID NO: 599 - RNA, 1182 nt, synthetic construct
  source 1..1182: mol_type = other RNA
atttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactgatga

SEQ ID NO: 600 - RNA, 1182 nt, synthetic construct
  source 1..1182: mol_type = other RNA
atttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaattgatga

SEQ ID NO: 601 - RNA, 1182 nt, synthetic construct
  source 1..1182: mol_type = other RNA
atttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactgatga

SEQ ID NO: 602 - RNA, 1182 nt, synthetic construct
  source 1..1182: mol_type = other RNA
atttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaattgatga

SEQ ID NO: 603 - RNA, 1269 nt, synthetic construct
  source 1..1269: mol_type = other RNA
atttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactccggctccatcctggccatctatagcaccgtggctagcagcctggtgctgctggtgtccctgggagctattagcttcggatctggctgataa

SEQ ID NO: 604 - RNA, 1269 nt, synthetic construct
  source 1..1269: mol_type = other RNA
atttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaatagcggctctattctggccatctacagtactgtggcttcctccctggtgctgctggtgtctctgggcgccatttccttcggctctggctgatga

SEQ ID NO: 605 - RNA, 1269 nt, synthetic construct
  source 1..1269: mol_type = other RNA
atttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactccggctccatcctggccatctatagcaccgtggctagcagcctggtgctgctggtgtccctgggagctattagcttcggatctggctgatga

SEQ ID NO: 606 - RNA, 1269 nt, synthetic construct
  source 1..1269: mol_type = other RNA
atttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaatagcggctctattctggccatctacagtactgtggcttcctccctggtgctgctggtgtctctgggcgccatttccttcggctctggctgatga

SEQ ID NO: 607 - RNA, 1182 nt, synthetic construct; identical to SEQ ID NO: 599
  source 1..1182: mol_type = other RNA

SEQ ID NO: 608 - RNA, 1182 nt, synthetic construct; identical to SEQ ID NO: 600
  source 1..1182: mol_type = other RNA

SEQ ID NO: 609 - RNA, 1182 nt, synthetic construct; identical to SEQ ID NO: 601
  source 1..1182: mol_type = other RNA

SEQ ID NO: 610 - RNA, 1182 nt, synthetic construct; identical to SEQ ID NO: 602
  source 1..1182: mol_type = other RNA

SEQ ID NO: 611 - RNA, 1269 nt, synthetic construct
  source 1..1269: mol_type = other RNA
atttccatgcgcatgggatactacggggacttcgtgttcgatcgcgtgctgaagacagatgtgaacaaggagtttcagatgggggacaaaccaacctctacaaccggaaatgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccacaagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatgtctttcgatcagagcgtggtggagctctataccgatacagcaaccagtggatacctgaggggcaactccgcctctttcaacctcgtggggctgttcggagattccgagaatgccacccagcctgctgcaacctccattcctaacgtgcagctgaaccagtccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccaccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccaccattgcaggatgcggctctgtggcaggcgcaaacactgagggccagatcagcgacacaatgcagatcgttagcctgcagttaaactccggctccatcctggccatctatagcaccgtggctagcagcctggtgctggtggtgtccctgggagctattagcttcggatctggctgatga

SEQ ID NO: 612 - RNA, 1269 nt, synthetic construct
  source 1..1269: mol_type = other RNA
atttccatgcggatgggatattacggcgacttcgtgttcgatcgggtgctgaagaccgacgtgaacaaggagttccagatgggagataagcctacatccacaactggcaacgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactacatcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatgtccttcgaccagtccgtggtggagctctacacagacaccgccacttccgggtatctgagaggcaattctgcctcttttaatctcgtgggactgttcggggattccgagaacgctacccagccagcagccacaagcattcccaacgtgcagctgaatcagtctgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccaaccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccacaatcgcagggtgtggaagcgtggctggcgctaacacagagggccagatctccgacaccatgcagatcgtgtctctccagctgaatagcggctctattctggccatctacagtactgtggcttcctccctggtgctggtggtgtctctgggcgccatttccttcggctctggctgatga

SEQ ID NO: 613 - RNA, 1269 nt, synthetic construct
  source 1..1269: mol_type = other RNA
atttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactccggctccatcctggccatctatagcaccgtggctagcagcctggtgctggtggtgtccctgggagctattagcttcggatctggctgatga

SEQ ID NO: 614 - RNA, 1269 nt, synthetic construct
  source 1..1269: mol_type = other RNA
atttccatgcggatgggatattacggcgacttcgtgttcgatcgggtgctgaagaccgacgtgaacaaggagttccagatgggagataagcctacatccacaactggcgccgctaccgctccaactactctgactgcccgggaaaatcctgcatacggcagacacatgcaggatatctcaatgcggatgggctattacggagacttcgtgttcgacagagtcctgaaaaccgatgtcaacaaggagttcgaaatgggcgaggctctggccggcgcctctggaaacactgcctcaaccctgagcaagctggtggagagaaccaaccctgcatatggaaagcatatgcaggacgctacttccggatatctgaaaggcaatagcgcctccttcaacctcgtgggcctctttggagataatgaaaaccagaagaccgtgaaggctgagtccgtgccaaacatggccttcgaccagtccgtggtggagctctacacagacaccgccacttccgggtatctgagaggcaattctgcctcttttaatctcgtgggactgttcggggattccgaggccgctacccagccagcagccacaagcattcccaacgtgcagctgaatcaggccgtggtcgagctgtacaccgacacagagtttaccatcaacaaacccaagggatatgtggggaaggagttccccctcgatctgaccgcaggcactgatgcagccaccggaactaaagatgcaagcattgattaccacgagtggcagaacatgttcacaccatacatcggcgtgaagtggtccagggccagcttcgacgctgataccattaggatcgcacagccaaaatccgctaccgccatcttcgatactaccactctgaatccagccattgccggcgcaggggatgtgaagacaggagccgagggccagctgggagatacaatgcagattgtgagcctccagctgaataacatgtttactccatacattggggtgaagtggtctagggccagctttgatagtgacaccattcggatcgcccagccaaggctggtcacacccgttgtggatatcacaacactgaaccccgccatcgcagggtgtggaagcgtggctggcgctaacacagagggccagatctccgacaccatgcagatcgtgtctctccagctgaatagcggctctattctggccatctacagtactgtggcttcctccctggtgctggtggtgtctctgggcgccatttccttcggctctggctgatga

SEQ ID NO: 615 - RNA, 1098 nt, synthetic construct
  source 1..1098: mol_type = other RNA
atttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtgatga

SEQ ID NO: 616 - RNA, 1098 nt, synthetic construct
  source 1..1098: mol_type = other RNA
atctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagtgatga

SEQ ID NO: 617 - RNA, 1098 nt, synthetic construct
  source 1..1098: mol_type = other RNA
atttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtgatga

SEQ ID NO: 618 - RNA, 1098 nt, synthetic construct
  source 1..1098: mol_type = other RNA
atctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagtgatga

SEQ ID NO: 619 - RNA, 1185 nt, synthetic construct
  source 1..1185: mol_type = other RNA
atttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtccggctccatcctggccatctatagcaccgtggctagcagcctggtgctgctggtgtccctgggagctattagcttcggatctggctgatga

SEQ ID NO: 620 - RNA, 1185 nt, synthetic construct
  source 1..1185: mol_type = other RNA
atctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagagcggctctattctggccatctacagtactgtggcttcctccctggtgctgctggtgtctctgggcgccatttccttcggctctggctgatga

SEQ ID NO: 621 - RNA, 1185 nt, synthetic construct
  source 1..1185: mol_type = other RNA
atttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtccggctccatcctggccatctatagcaccgtggctagcagcctggtgctgctggtgtccctgggagctattagcttcggatctggctgatga

SEQ ID NO: 622 - RNA, 1185 nt, synthetic construct
  source 1..1185: mol_type = other RNA
atctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagagcggctctattctggccatctacagtactgtggcttcctccctggtgctgctggtgtctctgggcgccatttccttcggctctggctgatga

SEQ ID NO: 623 - RNA, 1098 nt, synthetic construct; identical to SEQ ID NO: 615
  source 1..1098: mol_type = other RNA

SEQ ID NO: 624 - RNA, 1098 nt, synthetic construct; identical to SEQ ID NO: 616
  source 1..1098: mol_type = other RNA

SEQ ID NO: 625 - RNA, 1098 nt, synthetic construct; identical to SEQ ID NO: 617
  source 1..1098: mol_type = other RNA

SEQ ID NO: 626 - RNA, 1098 nt, synthetic construct; identical to SEQ ID NO: 618
  source 1..1098: mol_type = other RNA

SEQ ID NO: 627 - RNA, 1186 nt, synthetic construct
  source 1..1186: mol_type = other RNA
atttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtccggctccatcctggccatctatagcaccgtggctagcagcctggtgctggtggtgtccctgggagctattagcttcggatctggctgatgat

SEQ ID NO: 628 - RNA, 1185 nt, synthetic construct
  source 1..1185: mol_type = other RNA
atctctatgagaatgggctattacggcgactttgtgtttgaccgggtgttgaagaccgacgtgaacaaggagttccagatgggcgataagcctacatctacaaccggcaacgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacaacatccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatgtctttcgaccagtctgtggtggaactgtacaccgacacagctactagtgggtacctgcggggcaatagcgcatctttcaacctagtgggcctgtttggagattccgaaaatgccacccaaccagccgcaaccagcatccctaacgtgcagctgaaccagtccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctactattgcaggagccggggatgtgaaaaccggcgctgagggacagctgggagacaccatgcagcgcattgctcaaccacgcctggtcactcccgttgtggatatcaccactctgaaccccacaattgccggatgtggcagcgtggcaggggctaataccgagggccagatctctgacaccatgcagagcggctctattctggccatctacagtactgtggcttcctccctggtgctggtggtgtctctgggcgccatttccttcggctctggctgatga

SEQ ID NO: 629 - RNA, 1185 nt, synthetic construct
  source 1..1185: mol_type = other RNA
atttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtccggctccatcctggccatctatagcaccgtggctagcagcctggtgctggtggtgtccctgggagctattagcttcggatctggctgatga

SEQ ID NO: 630 - RNA, 1185 nt, synthetic construct
  source 1..1185: mol_type = other RNA
atctctatgagaatgggctattacggcgactttgtgtttgaccgggtgttgaagaccgacgtgaacaaggagttccagatgggcgataagcctacatctacaaccggcgccgcaacagctcccacaacactgactgccagggaaaaccctgcatacggacgccacatgcaggacgccgagatgttcaccaacgccgcatgcatggctctgaacattatcagcatgagaatgggctactatggggattttgtgttcgatcgcgtgctgaagaccgatgttaataaggaattcgagatgggagaggcactggcaggtgctagcggcaatacagcctccaccctgagcaagctggtcgagaggaccaacccagcttatggaaagcatatgcaggacgcagagatgtttaccaatgccgcctgcatgactctgaacatcgccacaagtggatacctgaagggcaactccgcatctttcaacctggtgggactgtttggcgataacgagaatcagaaaaccgttaaagcagagtctgtgcctaacatggccttcgaccagtctgtggtggaactgtacaccgacacagctactagtgggtacctgcggggcaatagcgcatctttcaacctagtgggcctgtttggagattccgaagccgccacccaaccagccgcaaccagcatccctaacgtgcagctgaaccaggccgtggtcgagctgtacactgataccgagtttactatcaacaagcctaaggggtacgtgggcaaggagttcccactggacctgactgccggcacagatgccgctacaggcacaaaagacgcttccatcgactatcacgagtggcagaggattgcccagcctaaaagtgccactgctatcttcgacacaaccacactgaaccctgccattgcaggagccggggatgtgaaaaccggcgctgagggacagctgggagacaccatgcagcgcattgctcaaccacgcctggtcactcccgttgtggatatcaccactctgaaccccgccattgccggatgtggcagcgtggcaggggctaataccgagggccagatctctgacaccatgcagagcggctctattctggccatctacagtactgtggcttcctccctggtgctggtggtgtctctgggcgccatttccttcggctctggctgatga

SEQ ID NO: 631 - RNA, 1119 nt, synthetic construct
  source 1..1119: mol_type = other RNA
ctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 632 - RNA, 1119 nt, synthetic construct
  source 1..1119: mol_type = other RNA
ctgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 633 - RNA, 1119 nt, synthetic construct
  source 1..1119: mol_type = other RNA
ctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 634 - RNA, 1119 nt, synthetic construct
  source 1..1119: mol_type = other RNA
ctgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatgtccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctaccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 635 - RNA, 1119 nt, synthetic construct
  source 1..1119: mol_type = other RNA
ctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 636 - RNA, 1119 nt, synthetic construct
  source 1..1119: mol_type = other RNA
ctgcccgtgggaaatcctgcagagccatccctgatgattgacgggattctgtgggagggctttggcggcgacccttgcgacccatgtgctacatggtgcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgcctgtatggccctgaacatttgggataggtttgacgtgttctgcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagtgtggatgcgctaccctgggcgcttctttccagtacgcacagtccaaaccaaaggtggaggaactgaatgtgctgtgcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtcctgcggaatcgccgtgggaactacaatcgtggatgctgataagtacgccgtgactgtggagacacgcctgatcgacgagagggccgcccacgtgaatgctcagttccgcttttgatga

SEQ ID NO: 637 - RNA, 1119 nt, synthetic construct
  source 1..1119: mol_type = other RNA
ctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 638 - RNA, 1119 nt, synthetic construct
  source 1..1119: mol_type = other RNA
ctgcccgtgggaaatcctgcagagccatccctgatgattgacgggattctgtgggagggctttggcggcgaccctagcgacccaagcgctacatggagcgatgccatcagcatgagggtggggtactatggagatttcgtgttcgatagagtgctgaagaccgacgtcaacaaggaattccagatgggggccaaacctactaccgacaccgggaactcagccgccccttctaccctgacagccagggaaaaccccgcttacgggagacacatgcaggatgccgagatgtttacaaacgccgccagcatggccctgaacatttgggataggtttgacgtgttcagcaccctgggagctacctctggatatctgaagggcaattccgcttcctttaacctggtgggcctgttcggcgataacgaaaatcaaaagaccgtgaaggccgagtccgtgcctaacatggccttcgaccagagcgttgtcgaactgtataccgatacaactttcgcatggtctgtgggcgcaagagcagccctgtgggagagcggaagcgctaccctgggcgcttctttccagtacgcacagtccaaaccaaaggtggaggaactgaatgtgctgagcaacgccgccgagtttaccattaacaaacccaagggctacgtgggaaaggagttccccctggatctgactgccggcaccgacgctgcaactggcactaaggatgccagcattgactaccacgagtggcaggctagcctcgccctgtcctatagactgaacatgttcacaccctatattggagtgaagtggagcagagccagcttcgacgccgacacaattcgcatcgcacagcccaagtccgcaactgccatcttcgacacaactaccctgaatcctgccattgctggcgctggggacgtgaaaacaggagccgaaggccagctgggcgacacaatgcagattgtcagcctgcaactgaataagatgaagtcccgcaagtccagcggaatcgccgtgggaactacaatcgtggatgctgataagtacgccgtgactgtggagacacgcctgatcgacgagagggccgcccacgtgaatgctcagttccgcttttgatga

SEQ ID NO: 639 - RNA, 1119 nt, synthetic construct; identical to SEQ ID NO: 631
  source 1..1119: mol_type = other RNA

SEQ ID NO: 640 - RNA, 1119 nt, synthetic construct; identical to SEQ ID NO: 632
  source 1..1119: mol_type = other RNA

SEQ ID NO: 641 - RNA, 1119 nt, synthetic construct; identical to SEQ ID NO: 633
  source 1..1119: mol_type = other RNA

SEQ ID NO: 642 - RNA, 1119 nt, synthetic construct; identical to SEQ ID NO: 634
  source 1..1119: mol_type = other RNA

SEQ ID NO: 643 - RNA, 1119 nt, synthetic construct; identical to SEQ ID NO: 635
  source 1..1119: mol_type = other RNA

SEQ ID NO: 644 - RNA, 1119 nt, synthetic construct; identical to SEQ ID NO: 636
  source 1..1119: mol_type = other RNA

SEQ ID NO: 645 - RNA, 1119 nt, synthetic construct; identical to SEQ ID NO: 637
  source 1..1119: mol_type = other RNA

SEQ ID NO: 646 - RNA, 1119 nt, synthetic construct; identical to SEQ ID NO: 638
  source 1..1119: mol_type = other RNA

SEQ ID NO: 647 - RNA, 1119 nt, synthetic construct
  source 1..1119: mol_type = other RNA
ctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 648 - RNA, 1119 nt, synthetic construct
  source 1..1119: mol_type = other RNA
ctgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctgatga

SEQ ID NO: 649 - RNA, 1119 nt, synthetic construct
  source 1..1119: mol_type = other RNA
ctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacagggaacgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcagtctactgttaagactaactctgtgcccaatatgagcctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctaccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 650 - RNA, 1119 nt, synthetic construct
  source 1..1119: mol_type = other RNA
ctgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 651 - RNA, 1119 nt, synthetic construct
  source 1..1119: mol_type = other RNA
ctgccagtggggaaccctgcagaaccctctctgatgatcgatggaattctgtgggagggcttcggcggggatccttgtgacccctgtaccacatggtgtgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgcctgtatggctctgaacatctgggaccggttcgacgtgttttgcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaatgcggctgcgcaacactgggggcttcctttcagtacgcccagagcaagcctaaagtggaagaactgaatgtgctgtgtaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtcctgcgggatcgctgtgggaacaactattgtggacgccgacaaatacgcagtgacagttgaaaccagactgatcgacgagcgcgccgcacacgtgaatgctcagtttaggttttgatga

SEQ ID NO: 652 - RNA, 1116 nt, synthetic construct
  source 1..1116: mol_type = other RNA
ctgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctga

SEQ ID NO: 653 - RNA, 1119 nt, synthetic construct
  source 1..1119: mol_type = other RNA
ctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 654 - RNA, 1119 nt, synthetic construct
  source 1..1119: mol_type = other RNA
ctgcctgtggggaatccagctgagcctagtctgatgatcgatggcatcctgtgggaaggctttgggggggaccctagcgacccaagcacaacatggagcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcaagcatggccctgaacatttgggataggtttgacgtgttcagcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagagcggcagcgccacacttggggcttctttccaatatgcccagtccaagccaaaggtggaagaactgaacgtgctgagcaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagtagcggcatcgccgtggggacaactattgtggatgcagataagtatgcagtgaccgtggagacaagactgattgacgagagagccgcccacgtgaacgcccaattccgcttctgatga

SEQ ID NO: 655 - RNA, 1119 nt, synthetic construct; identical to SEQ ID NO: 647
  source 1..1119: mol_type = other RNA

SEQ ID NO: 656 - RNA, 1119 nt, synthetic construct; identical to SEQ ID NO: 648
  source 1..1119: mol_type = other RNA

SEQ ID NO: 657 - RNA, 1119 nt, synthetic construct; identical to SEQ ID NO: 649
  source 1..1119: mol_type = other RNA

SEQ ID NO: 658 - RNA, 1119 nt, synthetic construct; identical to SEQ ID NO: 650
  source 1..1119: mol_type = other RNA

SEQ ID NO: 659 - RNA, 1119 nt, synthetic construct; identical to SEQ ID NO: 651
  source 1..1119: mol_type = other RNA

SEQ ID NO: 660 - RNA, 1119 nt, synthetic construct
  source 1..1119: mol_type = other RNA
ctgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcgccgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcaggccacagtgaagaccaatagcgtgcccaatatggccctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctgccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctgatga

SEQ ID NO: 661 - RNA, 1119 nt, synthetic construct; identical to SEQ ID NO: 653
  source 1..1119: mol_type = other RNA

SEQ ID NO: 662 - RNA, 1119 nt, synthetic construct; identical to SEQ ID NO: 654
  source 1..1119: mol_type = other RNA

SEQ ID NO: 663 - RNA, 1125 nt, synthetic construct
  source 1..1125: mol_type = other RNA
ctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 664 - RNA, 1125 nt, synthetic construct
  source 1..1125: mol_type = other RNA
ctgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 665 - RNA, 1125 nt, synthetic construct
  source 1..1125: mol_type = other RNA
ctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 666 - RNA, 1125 nt, synthetic construct
  source 1..1125: mol_type = other RNA
ctgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacaacatctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtgaacgcaacaaaaccagcagcagactctattcccaatgtgcagctgaaccagtccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccacaattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 667 - RNA, 1125 nt, synthetic construct
  source 1..1125: mol_type = other RNA
ctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 668 - RNA, 1125 nt, synthetic construct
  source 1..1125: mol_type = other RNA
ctgccagtggggaatcctgctgaaccatccctgatgatcgacgggattctgtgggagggctttggcggcgatccatgtgacccttgtaccacctggtgtgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagcctgtatgaccctgaacatttgggatagattcgacgtgttctgtaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagtgtggctgcgctacactgggcgcttccttccagtatgcacagtccaagccaaagattgaggagctcaacgtcctgtgtaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggatgcggatccgtggccggggccaatactgaaggacagatttctgatactatgcagatcgtgagcctgcagctgaataagatgaaaagcagaaagtcctgtgggatcgccgtgggaactaccatcgtcgacgcagacaaatatgcagtcaccgtggagacacggctgattgacgagagagctgcccacgtcaatgcccagttccgcttctgatga

SEQ ID NO: 669 - RNA, 1125 nt, synthetic construct
  source 1..1125: mol_type = other RNA
ctgccagtgggaaatccagccgaacctagcctgatgattgatggcatcctgtgggagggctttggaggcgatccaagcgatcctagcactacttggagcgacgccatttccatgcgcatgggctactatggcgatttcgtgttcgaccgcgtgctgaaaaccgacgtgaacaaggagttcgaaatgggcgaagccctggctggcgcaagcggaaacactgcctccaccctgtccaagctggtggagaggacaaaccccgcctatggaaagcatatgcaggacgccgaaatgttcacaaatgccgcaagcatgacactgaatatctgggacagatttgacgtcttcagcacactgggcgccacaagcggatacctgaagggcaactctgccagttttaacctggtcggactgttcggcgacggcgtggccgccaccaaaccagccgcagactctattccaaacgttcagctgaaccaggccgtcgtggagctgtacaccgacaccacattcgcttggtccgtcggagcaagagctgccctgtgggagagcgggagcgctacactcggcgcatccttccagtatgcccagtctaagcccaaaattgaggagctcaacgtgctgagcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccagccatcgctggaagcggctctgtggccggagcaaacacagaggggcagatcagcgacactatgcagatcgtgtctctgcagctgaacaaaatgaagtctcgcaagtccagcggcatcgcagtgggcacaactatcgtggatgctgataagtatgccgtgactgttgaaacccggctgatcgacgagcgcgcagcccacgtgaatgctcagtttaggttttgatga

SEQ ID NO: 670 - RNA, 1125 nt, synthetic construct
  source 1..1125: mol_type = other RNA
ctgccagtggggaatcctgctgaaccatccctgatgatcgacgggattctgtgggagggctttggcggcgatccaagcgaccctagcaccacctggagcgacgctatttccatgaggatgggatactacggcgatttcgtgttcgaccgcgtgctgaagactgacgtcaacaaggaattcgagatgggagaggctctggccggcgcttctggcaacacagcctctactctgagcaaactggtggagagaactaaccctgcctacgggaagcacatgcaggatgcagagatgttcaccaacgcagccagcatgaccctgaacatttgggatagattcgacgtgttcagcaccctgggggccacctctggctatctgaagggaaatagcgcctccttcaacctggttggactgtttggcgacggcgtggccgcaacaaaaccagcagcagactctattcccaatgtgcagctgaaccaggccgtcgtggaactgtacaccgacaccacatttgcttggtccgttggagcaagggctgccctgtgggagagcggcagcgctacactgggcgcttccttccagtatgcacagtccaagccaaagattgaggagctcaacgtcctgagcaacgccgccgagtttacaattaacaagccaaaggggtatgtggggaaggagttccccctggacctgactgccggcacagatgccgccacaggcactaaggacgcttccattgactatcatgagtggcaggcctccctgtctctgtcttatcgcctgaacatgtttaccccttatatcggcgtgaagtggagcagagcatctttcgattcagacaccattaggatcgcccagccacgcctggtgacccccgtggtcgacatcacaactctgaatcccgccattgccggaagcggatccgtggccggggccaatactgaaggacagatttctgatactatgcagatcgtgagcctgcagctgaataagatgaaaagcagaaagtccagcgggatcgccgtgggaactaccatcgtcgacgcagacaaatatgcagtcaccgtggagacacggctgattgacgagagagctgcccacgtcaatgcccagttccgcttctgatga

SEQ ID NO: 671 - RNA, 1125 nt, synthetic construct; identical to SEQ ID NO: 663
  source 1..1125: mol_type = other RNA

SEQ ID NO: 672 - RNA, 1125 nt, synthetic construct; identical to SEQ ID NO: 664
  source 1..1125: mol_type = other RNA

SEQ ID NO: 673 - RNA, 1125 nt, synthetic construct; identical to SEQ ID NO: 665
  source 1..1125: mol_type = other RNA

SEQ ID NO: 674 - RNA, 1125 nt, synthetic construct; identical to SEQ ID NO: 666
  source 1..1125: mol_type = other RNA

SEQ ID NO: 675 - RNA, 1125 nt, synthetic construct; identical to SEQ ID NO: 667
  source 1..1125: mol_type = other RNA

SEQ ID NO: 676 - RNA, 1125 nt, synthetic construct; identical to SEQ ID NO: 668
  source 1..1125: mol_type = other RNA

SEQ ID NO: 677 - RNA, 1125 nt, synthetic construct; identical to SEQ ID NO: 669
  source 1..1125: mol_type = other RNA

SEQ ID NO: 678 - RNA, 1125 nt, synthetic construct; identical to SEQ ID NO: 670
  source 1..1125: mol_type = other RNA

SEQ ID NO: 679 - RNA, 1125 nt, synthetic construct
  source 1..1125: mol_type = other RNA
ctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 680 - RNA, 1125 nt, synthetic construct
  source 1..1125: mol_type = other RNA
ctgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 681 - RNA, 1125 nt, synthetic construct
  source 1..1125: mol_type = other RNA
ctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 682 - RNA, 1125 nt, synthetic construct
  source 1..1125: mol_type = other RNA
ctgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 683 - RNA, 1125 nt, synthetic construct
  source 1..1125: mol_type = other RNA
ctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 684 - RNA, 1125 nt, synthetic construct
  source 1..1125: mol_type = other RNA
ctgccagtgggaaaccctgccgaaccttccctcatgatcgacggaatcctgtgggagggcttcgggggagatccttgtgacccctgtaccacttggtgcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcatgtatggccctgaatatctgggaccgatttgatgtcttctgtaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagtgtgggtgcgctactctgggagccagtttccaatacgcacagtctaagcccaaagtggaagaactgaacgtgctgtgtaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggctgcggctcagtggtcgctgcaaacaccgaaggacagatttccgatactatgcagattgtctccctccagctgaataagatgaagtccagaaagagctgtggcattgcagttggcactacaatcgtggacgccgataaatacgccgtgacagtggagacaaggctgattgatgaacgggctgcccacgtgaatgcccagttccgcttctgatga

SEQ ID NO: 685 - RNA, 1125 nt, synthetic construct
  source 1..1125: mol_type = other RNA
ctcccagttggcaatcctgccgagccatccctgatgattgatggaatcctgtgggagggcttcggcggagatccaagcgatcccagcacaacctggagcgacgccatttccatgcggatgggctattacggggactttgtgttcgacagagtgctgaagacagacgtgaataaggagttcgaaatgggagaggcactggctggagcctctggaaacacagccagcacactgagcaagctggtggagcggacaaaccctgcttacggcaagcacatgcaggatgcagagatgttcactaatgccgcaagcatggctctgaatatctgggatcgcttcgacgtgtttagcactctgggcgccacttccggctatctgagaggcaatagtgcttccttcaacctggtcgggctgttcggcgattccgaggccgctactcagcccgctgcaaccagcattcccaatgtgcaactgaatcaggccgtggtggaactgtatactgatactgcattcgcctggtctgtcggagctagagccgctctgtgggagagcggaagcgccactctgggagcttcctttcagtatgcacagagcaaacctaaagtggaggaactgaatgtgctgagcaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccgccatcgctggaagcgggagcgttgtggcagctaacactgaggggcagatctctgacactatgcagatcgtttccttgcagctgaacaaaatgaagtcccgcaaatctagcggcattgctgtgggcaccaccattgtggacgccgacaagtatgccgtgacagtggagacaaggctgattgacgaaagggccgcccacgtgaacgcacagtttaggttttgatga

SEQ ID NO: 686 - RNA, 1125 nt, synthetic construct
  source 1..1125: mol_type = other RNA
ctgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactgccagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgaggccgccacccagccagccgctacaagcatccctaacgtgcagctgaaccaggccgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctgccatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 687 - RNA, 1125 nt, synthetic construct; identical to SEQ ID NO: 679
  source 1..1125: mol_type = other RNA

SEQ ID NO: 688 - RNA, 1125 nt, synthetic construct; identical to SEQ ID NO: 680
  source 1..1125: mol_type = other RNA

SEQ ID NO: 689 - RNA, 1125 nt, synthetic construct; identical to SEQ ID NO: 681
  source 1..1125: mol_type = other RNA

SEQ ID NO: 690 - RNA, 1125 nt, synthetic construct; identical to SEQ ID NO: 682
  source 1..1125: mol_type = other RNA

SEQ ID NO: 691 - RNA, 1125 nt, synthetic construct; identical to SEQ ID NO: 683
  source 1..1125: mol_type = other RNA

SEQ ID NO: 692 - RNA, 1125 nt, synthetic construct; identical to SEQ ID NO: 684
  source 1..1125: mol_type = other RNA

SEQ ID NO: 693 - RNA, 1125 nt, synthetic construct; identical to SEQ ID NO: 685
  source 1..1125: mol_type = other RNA

SEQ ID NO: 694 - RNA, 1125 nt, synthetic construct; identical to SEQ ID NO: 686
  source 1..1125: mol_type = other RNA

SEQ ID NO: 695 - RNA, 822 nt, synthetic construct
  source 1..822: mol_type = other RNA
aacatgttcactccatatattggcgtcaaatggtcccgggccagcttcgacgccgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctaccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaac

SEQ ID NO: 696 - RNA, 822 nt, synthetic construct
  source 1..822: mol_type = other RNA
aacatgtttacaccttacatcggggtgaagtggagcagagccagcttcgacgccgatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctacaattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaat

SEQ ID NO: 697 - RNA, 909 nt, synthetic construct
  source 1..909: mol_type = other RNA
aacatgttcactccatatattggcgtcaaatggtcccgggccagcttcgacgccgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctaccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggc

SEQ ID NO: 698 - RNA, 909 nt, synthetic construct
  source 1..909: mol_type = other RNA
aacatgtttacaccttacatcggggtgaagtggagcagagccagcttcgacgccgatactatccggattgctcaaccaaaatccgccaccgccatttttgatacaactacactgaacccaacaatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccaacaatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctacaattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccacaatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggc

SEQ ID NO: 699 - RNA, 822 nt, synthetic construct
  source 1..822: mol_type = other RNA
aacatgttcactccatatattggcgtcaaatggtcccgggccagcttcgacgccgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctgccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaac

SEQ ID NO: 700 - RNA, 822 nt, synthetic construct
  source 1..822: mol_type = other RNA
aacatgtttacaccttacatcggggtgaagtggagcagagccagcttcgacgccgatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctgccattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaat

SEQ ID NO: 701 - RNA, 909 nt, synthetic construct
  source 1..909: mol_type = other RNA
aacatgttcactccatatattggcgtcaaatggtcccgggccagcttcgacgccgatactatcagaatcgcccagccaaaatccgctacagcaatctttgatacaacaaccctgaatccagccatcgccggcgcaggcgacgtgaagacaggggccgagggccagctgggagatacaatgcagatcgtctccctgcagctgaacaacatgtttacaccttacatcggagtgaagtggagccgcgccagcttcgacgccgacacaatcaggatcgcccaacccaagagcgctacagctatttttgacaccactaccctgaacccagccatcgctggagctggcgacgtgaaagcatccgccgagggccagctcggcgataccatgcagatcgtgtctctccagctgaataacatgttcacaccctacatcggcgttaagtggagcagagccagcttcgattccgatactatcaggatcgcccagcccaggctcgtgacccctgtcgtggatatcacaaccctgaaccctgccattgccgggagcggaagcgtggctggcgccaacacagagggccagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccgccattgctggcagcggcagcgtggtggcagcaaactctgagggacagatttctgatacaatgcagattgtctcactgcagctgaactccggctccatcctggccatctatagcaccgtggctagcagcctggtgctgctggtgtccctgggagctattagcttcggatctggc

SEQ ID NO: 702 - RNA, 909 nt, synthetic construct
  source 1..909: mol_type = other RNA
aacatgtttacaccttacatcggggtgaagtggagcagagccagcttcgacgccgatactatccggattgctcaaccaaaatccgccaccgccatttttgatacaactacactgaacccagccatcgccggcgccggagacgtgaaaacaggcgcagaaggccagctgggggatactatgcagatcgtgtccctgcaactgaacaacatgtttacaccctacatcggagtcaagtggtctagggccagcttcgatgccgataccatcagaattgcccagcctaagtctgccactgccattttcgacacaactactctgaacccagccatcgctggagcaggcgacgtgaaggcatctgccgaaggccagctgggagacactatgcagatcgtgagcctgcaactgaataacatgttcactccatacattggagtgaagtggagtcgggccagcttcgattctgacacaatccggatcgcccaaccaagactggttacacccgtcgtggacatcacaactctgaatcctgccattgctggcagcgggagcgtggcaggcgcaaatactgaaggccagatcagcgacacaatgcagatcgtcagcctgcagctgaataacatgttcaccccctacatcggcgtcaagtggagtagagccagcttcgattctaacacaattcggattgctcaacccaagctggcaaagccagtggtcgacatcaccaccctgaaccccgccatcgccggcagcggctccgtggtggcagctaactccgagggacagatttctgacaccatgcagatcgtctctctgcagctcaatagcggctctattctggccatctacagtactgtggcttcctccctggtgctgctggtgtctctgggcgccatttccttcggctctggc

SEQ ID NO: 703 - RNA, 1500 nt, synthetic construct
  source 1..1500: mol_type = other RNA
gacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacagtaaaagccgagagcgtgcctaatatgagctttgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagagccagcttcgatgccgataccattaggattgctcagccaaaaagcgcaaccgccatttttgatactactactctgaatcccacaattgccggcgcaggcgatgtcaagactggggccgagggacagctgggagatacaatgcagatcgtgtccctgcagctgaacaacatgtttacaccatatattggtgtcaagtggagcagggccagctttgatgccgatactattagaatcgcccagcccaagtccgccacagcaatctttgacactacaaccctgaaccctaccattgctggcgccggggacgtgaaagcatccgccgaagggcagctgggcgatacaatgcagatcgtctccctgcagctcaataacatgttcaccccttacattggggtgaaatggagcagagccagctttgatagtgataccattcggattgctcagccccggctcgtcactcccgtggtggatattaccacactgaaccctactattgctgggagcggctctgtggctggcgctaatacggaaggccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccaacaattgccggaagcgggtctgtggtcgccgcaaactctgagggacagatctctgacactatgcagattgtgagcctgcagctgaac

SEQ ID NO: 704 - RNA, 1500 nt, synthetic construct
  source 1..1500: mol_type = other RNA
gacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccgtgaaggccgagtccgtccctaatatgtctttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctagggccagctttgacgccgatacgattagaattgctcagcctaaaagcgccaccgcaattttcgatactactacactgaacccaaccatcgctggagcaggcgatgtgaagaccggcgcagagggacaactgggcgacactatgcagattgtgagtctgcagctcaataacatgttcactccttatattggggtgaaatggtccagagccagcttcgacgccgacaccatcagaattgctcagcccaagtctgctacagccatcttcgacaccactaccctgaacccaactattgctggagccggagacgtcaaagcctcagcagaggggcaactgggcgataccatgcagatcgtgtctctgcagctcaacaacatgtttaccccgtatattggcgtgaagtggtcacgggccagctttgactctgacacaattagaatcgcccagcctagactggtgacacccgttgttgacatcacaacactgaacccaacaatcgccggatctggcagcgtcgccggcgccaatactgagggccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccaaccattgctggaagcgggtccgtggtggccgcaaatagcgagggccagatttctgacaccatgcagattgtgtccctgcagctgaac

SEQ ID NO: 705 - RNA, 1503 nt, synthetic construct
  source 1..1503: mol_type = other RNA
gacgccatctctatgcgcgtggggtattacggggatttcgtgttcgatagagtgctgaaaacagacgtgaataaggaattccagatgggagccaagccaactaccgacacagggaacagcgctgcccctagcactctcacagccagagagaatccagcatacggaagacacatgcaggatgccgaaatgtttacaaatgcagcctccatggccctcaatatctgggacaggttcgatgtcttctctacactgggagcaacttctggctatctgaaagggaattccgctagctttaacctggtgggactgttcggcgataacgagaaccagaagacaaacgtaaaagccgagagcgtgcctaatatggccttcgaccagtctgtcgtggaactgtatactgatacaacatttgcatggagcgtgggggctagagctgcactgtgggagagcggatcagccacactcggagcctccttccagtatgctcagtccaagcccaaggtggaggagctcaacgtgctgtctaacgcagccgagtttactattaacaaacccaaaggctatgtcggcaaagaattcccactggacctcactgctggcaccgacgcagctacaggcactaaggatgcctccattgattatcatgagtggcaagcctccctcgccctgagctatcggctcaacatgttcacaccttacatcggcgtgaagtggagcagagccagcttcgatgccgataccattaggattgctcagccaaaaagcgcaaccgccatttttgatactactactctgaatcccgccatcgccggcgcaggcgatgtcaagactggggccgagggacagctgggagatacaatgcagatcgtgtccctgcagctgaacaacatgtttacaccatatattggtgtcaagtggagcagggccagctttgatgccgatactattagaatcgcccagcccaagtccgccacagcaatctttgacactacaaccctgaaccctgccatcgctggcgccggggacgtgaaagcatccgccgaagggcagctgggcgatacaatgcagatcgtctccctgcagctcaataacatgttcaccccttacattggggtgaaatggagcagagccagctttgatagtgataccattcggattgctcagccccggctcgtcactcccgtggtggatattaccacactgaaccctgccatcgctgggagcggctctgtggctggcgctaatacggaaggccagatctccgacactatgcagatcgtgagcctgcagctgaataacatgttcactccatacatcggggtcaaatggtcaagggcctccttcgacagcaataccatccggatcgcccagccaaagctggccaagcccgtggttgacatcactacactgaacccagccatcgccggaagcgggtctgtggtcgccgcaaactctgagggacagatctctgacactatgcagattgtgagcctgcagctgaac

SEQ ID NO: 706 - RNA, 1503 nt, synthetic construct
  source 1..1503: mol_type = other RNA
gacgcaatttccatgagagtcggatattacggagacttcgttttcgatagagtgctgaagaccgacgtgaacaaggagttccagatgggggcaaagccaaccaccgatacagggaattctgcagccccatctactctgaccgcaagagagaacccagcctatggcagacacatgcaggacgcagagatgttcacaaacgctgcctccatggcactgaatatttgggacaggttcgacgtgttttctactctgggggccactagcggctacctaaagggaaactccgccagctttaacctggtgggcctgttcggggacaatgaaaaccagaaaaccaacgtgaaggccgagtccgtccctaatatggccttcgatcagagcgttgtggaactgtatactgacaccacatttgcttggagcgtgggagccagagccgctctctgggaatctgggtcagcaacactgggagcatccttccagtacgcccaaagcaagcctaaagtggaggagctgaacgtgctctctaacgcagccgagtttaccatcaacaagcctaagggctatgtggggaaggagtttcctctggacctgactgcaggaactgacgctgctacaggcacaaaggatgcctccatcgattaccacgaatggcaggcctctctggccctcagctatcgcctgaacatgttcaccccttacattggcgtgaaatggtctagggccagctttgacgccgatacgattagaattgctcagcctaaaagcgccaccgcaattttcgatactactacactgaacccagccatcgctggagcaggcgatgtgaagaccggcgcagagggacaactgggcgacactatgcagattgtgagtctgcagctcaataacatgttcactccttatattggggtgaaatggtccagagccagcttcgacgccgacaccatcagaattgctcagcccaagtctgctacagccatcttcgacaccactaccctgaacccagccatcgctggagccggagacgtcaaagcctcagcagaggggcaactgggcgataccatgcagatcgtgtctctgcagctcaacaacatgtttaccccgtatattggcgtgaagtggtcacgggccagctttgactctgacacaattagaatcgcccagcctagactggtgacacccgttgttgacatcacaacactgaacccagccatcgccggatctggcagcgtcgccggcgccaatactgagggccaaatctctgacactatgcagatcgtgagcctccagctgaacaacatgtttactccctacattggagtcaagtggtccagggcttctttcgactccaacactatccggattgctcagcctaagctggctaagcccgtggtggatattacaaccctcaacccagccatcgctggaagcgggtccgtggtggccgcaaatagcgagggccagatttctgacaccatgcagattgtgtccctgcagctgaac

SEQ ID NO: 707 - RNA, 1548 nt, synthetic construct
  source 1..1548: mol_type = other RNA
gagtctctgagcaccaatgtgatcagcctggcagacaccaaggccaaggacaacacctcccacaaaagcaaaaaagccaggaagaaccactccaaggagacactggtggaccggaaagaggttgcacccgtgcatgagagcaaggccaccggccccaagcaggattcttgctttggacggatgtatacagtgaaggtgaatgatgacagaaacgtggagattactcaggctgtgcctgagtacgccaccgtggggtccccctaccctattgaaatcaccgcaaccgggaagagagactgtgttgacgtgatcatcacacagcagctgccctgtgaggctgagtttgtgaggagcgacccagctaccacccccactgccgatgggaagctggtgtggaagattgacaggctggggcagggagagaagtctaaaatcacagtgtgggtgaagcctctgaaagaaggatgttgctttacagccgcaacagtctgcgcatgtccagagattcgcagcgtgacaaaatgcgggcagcctgccatctgcgtgaagcaggagggaccagagaatgcttgcctgcgctgtccagtggtttacaaaatcaacgtggtgaaccagggcacagccatcgccagaaacgtggtggtggaaaaccccgtgcctgatggctacgcccattctagcggccagagagtgctgacttttacactgggggacatgcagcctggcgagcatcgcacaattactgtggagttctgtcccctgaagagaggccgggctaccaacatcgccacagtgtcttactgtggaggccacaagaatacagccagtgtcaccacagtgattaatgaaccatgtgtgcaggtgtctatcgcaggggctgattggtcctatgtgtgcaagcctgtggaatacgtgattagcgtgtccaaccctggggacctggttctgagagacgtggttgtggaggatacactgagccctggcgtgacagtgctggaggccgccggcgctcagatttcttgcaataaggtggtgtggacagtgaaagagctgaatcccggcgagagcctgcagtacaaggtgctggtgcgggcccagacccctggacagtttaccaataatgtggtcgtcaagtcctgctcagactgtggcacatgtacatcttgcgcagaggccacaacctattggaaaggggtcgccgcaacccacatgtgtgtggtggacacttgcgatcctgtgtgcgtcggagagaataccgtgtatcggatctgcgtgaccaacagaggcagcgcagaggacactaacgtgtccctgatgctgaaattttctaaggagctgcagcccgtgtccttttctggccctactaagggaaccattaccggaaacacagtggtgtttgactctctgcccagactgggctccaaggagacagttgagttctccgtgacactgaaagcagtgtcagccggagatgctagaggggaggccatcctgtcctctgacacactgaccgtgccagtcagcgacactgagaacacacacatttat

SEQ ID NO: 708 - RNA, 1548 nt, synthetic construct
  source 1..1548: mol_type = other RNA
gagagcctgtccaccaatgtgatttccctggccgacactaaggctaaagacaacacttcccacaaaagcaagaaagccagaaagaaccactcaaaggagacactggttgaccggaaagaagtggccccagtgcatgaaagcaaagccactggaccaaagcaggactcctgcttcggcagaatgtatacagttaaggtgaacgatgaccggaatgtggagatcactcaggccgtgccagagtacgccaccgtgggatctccttatccaattgagatcaccgccacagggaaaagggactgtgtggacgtgattattacacagcagctgccatgtgaagccgagttcgtgcgcagcgatccagccactactcccaccgccgatggaaaactggtgtggaagattgatcggctgggccagggcgagaagtctaaaattactgtgtgggtcaagcccctgaaagagggctgttgcttcaccgctgccactgtgtgtgcctgtccagagatccggtctgtgactaaatgtggccagccagcaatctgcgtgaagcaggagggaccagagaatgcttgtctgcgctgtcctgtggtgtataagattaatgtggtcaaccagggcaccgccattgctaggaacgtggtggtggaaaaccctgtgcccgatgggtatgcccattcttctgggcagagagtgctgacctttactctgggagatatgcagcctggcgagcacagaaccatcaccgtcgagttctgccccctgaaaagagggagagcaacaaacatcgccacagtgagctattgtggcggccacaaaaacaccgcctctgtgactaccgtcatcaatgagccttgtgtgcaggtgtcaatcgccggcgccgattggagctacgtgtgcaaacccgtggagtacgtcatttccgtgtcaaacccaggcgacctggtgctgagagatgtggtcgtggaggacactctgtctcctggcgtgacagtgctggaggcagccggcgcacaaatctcatgtaataaggtggtgtggacagtcaaagagctgaaccccggagagtctctgcagtacaaggtgctggtgagagcccagacacctggacaattcaccaacaacgtggtggtgaaatcctgttctgattgtggaacctgcacatcctgcgccgaggccactacctactggaaaggggttgccgccactcatatgtgcgtggtggatacatgcgacccagtgtgcgtgggcgagaatacagtgtacagaatttgcgtgactaaccgcggatctgccgaggatactaacgtgagcctgatgctgaagttctccaaggagctgcagcctgtttccttttccgggccaaccaagggcactattaccggcaacaccgttgtgttcgactctctgcctagactggggtctaaagaaacagtggaattttccgtgaccctgaaggccgtttccgccggagatgccaggggagaagcaatcctgagtagcgacacactgactgtgcccgtgagcgacacagagaacactcacatctat

SEQ ID NO: 709 - RNA, 1548 nt, synthetic construct
  source 1..1548: mol_type = other RNA
gagtctctgagcaccaatgtgatcagcctggcagacaccaaggccaaggaccagacctcccacaaaagcaaaaaagccaggaagcagcactccaaggagacactggtggaccggaaagaggttgcacccgtgcatgagagcaaggccaccggccccaagcaggattcttgctttggacggatgtatacagtgaaggtgaatgatgacagaaacgtggagattactcaggctgtgcctgagtacgccaccgtggggtccccctaccctattgaaatcaccgcaaccgggaagagagactgtgttgacgtgatcatcacacagcagctgccctgtgaggctgagtttgtgaggagcgacccagctaccacccccactgccgatgggaagctggtgtggaagattgacaggctggggcagggagagaagtctaaaatcacagtgtgggtgaagcctctgaaagaaggatgttgctttacagccgcaacagtctgcgcatgtccagagattcgcagcgtgacaaaatgcgggcagcctgccatctgcgtgaagcaggagggaccagagaatgcttgcctgcgctgtccagtggtttacaaaatcaacgtggtgaaccagggcacagccatcgccagaaacgtggtggtggaaaaccccgtgcctgatggctacgcccattctagcggccagagagtgctgacttttacactgggggacatgcagcctggcgagcatcgcacaattactgtggagttctgtcccctgaagagaggccgggctaccaacatcgccacagtgtcttactgtggaggccacaagaatacagccagtgtcaccacagtgattaatgaaccatgtgtgcaggtgtctatcgcaggggctgattggtcctatgtgtgcaagcctgtggaatacgtgattagcgtgtccaaccctggggacctggttctgagagacgtggttgtggaggatacactgagccctggcgtgacagtgctggaggccgccggcgctcagatttcttgcaataaggtggtgtggacagtgaaagagctgaatcccggcgagagcctgcagtacaaggtgctggtgcgggcccagacccctggacagtttaccaataatgtggtcgtcaagtcctgctcagactgtggcacatgtacatcttgcgcagaggccacaacctattggaaaggggtcgccgcaacccacatgtgtgtggtggacacttgcgatcctgtgtgcgtcggagagaataccgtgtatcggatctgcgtgaccaacagaggcagcgcagaggacactcaggtgtccctgatgctgaaattttctaaggagctgcagcccgtgtccttttctggccctactaagggaaccattaccggaaacacagtggtgtttgactctctgcccagactgggctccaaggagacagttgagttctccgtgacactgaaagcagtgtcagccggagatgctagaggggaggccatcctgtcctctgacacactgaccgtgccagtcagcgacactgagaacacacacatttat

SEQ ID NO: 710 - RNA, 1548 nt, synthetic construct
  source 1..1548: mol_type = other RNA
gagagcctgtccaccaatgtgatttccctggccgacactaaggctaaagaccagacttcccacaaaagcaagaaagccagaaagcagcactcaaaggagacactggttgaccggaaagaagtggccccagtgcatgaaagcaaagccactggaccaaagcaggactcctgcttcggcagaatgtatacagttaaggtgaacgatgaccggaatgtggagatcactcaggccgtgccagagtacgccaccgtgggatctccttatccaattgagatcaccgccacagggaaaagggactgtgtggacgtgattattacacagcagctgccatgtgaagccgagttcgtgcgcagcgatccagccactactcccaccgccgatggaaaactggtgtggaagattgatcggctgggccagggcgagaagtctaaaattactgtgtgggtcaagcccctgaaagagggctgttgcttcaccgctgccactgtgtgtgcctgtccagagatccggtctgtgactaaatgtggccagccagcaatctgcgtgaagcaggagggaccagagaatgcttgtctgcgctgtcctgtggtgtataagattaatgtggtcaaccagggcaccgccattgctaggaacgtggtggtggaaaaccctgtgcccgatgggtatgcccattcttctgggcagagagtgctgacctttactctgggagatatgcagcctggcgagcacagaaccatcaccgtcgagttctgccccctgaaaagagggagagcaacaaacatcgccacagtgagctattgtggcggccacaaaaacaccgcctctgtgactaccgtcatcaatgagccttgtgtgcaggtgtcaatcgccggcgccgattggagctacgtgtgcaaacccgtggagtacgtcatttccgtgtcaaacccaggcgacctggtgctgagagatgtggtcgtggaggacactctgtctcctggcgtgacagtgctggaggcagccggcgcacaaatctcatgtaataaggtggtgtggacagtcaaagagctgaaccccggagagtctctgcagtacaaggtgctggtgagagcccagacacctggacaattcaccaacaacgtggtggtgaaatcctgttctgattgtggaacctgcacatcctgcgccgaggccactacctactggaaaggggttgccgccactcatatgtgcgtggtggatacatgcgacccagtgtgcgtgggcgagaatacagtgtacagaatttgcgtgactaaccgcggatctgccgaggatactcaggtgagcctgatgctgaagttctccaaggagctgcagcctgtttccttttccgggccaaccaagggcactattaccggcaacaccgttgtgttcgactctctgcctagactggggtctaaagaaacagtggaattttccgtgaccctgaaggccgtttccgccggagatgccaggggagaagcaatcctgagtagcgacacactgactgtgcccgtgagcgacacagagaacactcacatctat

SEQ ID NO: 711 - RNA, 546 nt, synthetic construct
  source 1..546: mol_type = other RNA
accacaaaacccaaaacactggagatcgacaataacacttttctgctgctggaaggaaatctgaagaggattttcgccacacctattggctacactacttttcgcgagtttcagaatgtggtgttcaactgcgcccagggacagcaggagctggctaatttcctgttcgagatgctgattaacggcaagctgctccaggagctgccagcaggccagaagcagtcagcccagagcctgatcgtgcagttcatgatgcctattagagtggctaaggacattcacgagagaggcgaattcatcaatttcatcacttctgacatgctggcccagcaggagcgctgcgtgttcctgaataggctgagcagggtggatggccaagagtttctgctgatgacagacgtgcagaatacctgccacctgattagacacctgctctccaggctgctggaagcccagaaaaacccaattggagaaaagaacctgcaggagatccaggaggatctggatagcctgcgggcacactttgaggagctgaccaagtctgtg

SEQ ID NO: 712 - RNA, 546 nt, synthetic construct
  source 1..546: mol_type = other RNA
acaacaaaacccaagaccctggaaattgacaacaatacctttctgctgctggagggcaacctgaaacgcatcttcgccacaccaattggctatacaacttttagagagttccagaacgtggttttcaactgcgcacagggacagcaggagctggccaacttcctgttcgaaatgctgatcaatgggaagctgctgcaggagctgccagccggccagaaacagtctgcacagtccctgattgtgcagttcatgatgcccattagggtggctaaggacatccacgagagaggcgagtttatcaattttatcacaagcgacatgctggctcagcaagaaaggtgcgtcttcctgaatcgcctgtcccgcgtggacggacaggagttcctgctgatgaccgacgtccaaaacacctgtcacttgatcagacacctgctgtccaggctgctggaggctcagaagaatccaatcggcgaaaagaatctgcaggagattcaggaagacctggactccctgcgcgcccacttcgaagaactgacaaaaagcgtg

SEQ ID NO: 713 - RNA, 546 nt, synthetic construct
  source 1..546: mol_type = other RNA
acaaccaaacctaaaactctggaaatcgacaataacacattcctgctgctggaggggaacctgaagcggatttttgccaccccaatcggatacacaaccttcagggagtttcagaacgtggtgtttaactccgcccagggccagcaggagctggcaaatttcctgtttgaaatgctgattaatggcaagctgctgcaggaactgcccgccggacagaaacagtccgcccagagcctgattgtgcagtttatgatgcccatcagggtggctaaggatatccacgagagaggcgagttcattaacttcattaccagcgacatgctcgcccagcaggaaagatccgtgttcctgaaccggctgtctcgggtggatggacaggagttcctgctgatgaccgacgtgcaaaatacctctcacctgatccgccacctgctgtccagactgctggaggcccagaagaacccaattggcgagaaaaatctccaggaaatccaggaagacctggacagcctgagagcccacttcgaggagctgaccaagagcgtc

SEQ ID NO: 714 - RNA, 546 nt, synthetic construct
  source 1..546: mol_type = other RNA
actaccaaacccaagacactggagatcgacaataatacttttctgctgctggaggggaacctgaaacgcatttttgctacccctattggctacactacctttagagagttccagaacgtggtgttcaattccgcccagggacagcaggaactggccaacttcctgttcgaaatgctgatcaacggcaagctgctccaagagctgcctgccggacagaagcagagcgctcagtctctgatcgtgcagttcatgatgccaattcgggtggctaaggacatccatgagcgcggagagttcatcaactttatcacctccgatatgctggcccagcaggagaggagcgtgtttctgaacagactgagcagagttgacggacaggagttcctgctgatgaccgacgtgcagaacacctctcacctgatccggcacctgctgagtagactgctggaggcccagaaaaaccctattggcgagaaaaatctgcaggagattcaggaggatctggattcactccgcgcccacttcgaagaactgactaagagcgtg

SEQ ID NO: 715 - RNA, 546 nt, synthetic construct
  source 1..546: mol_type = other RNA
acaaccaagcctaagaccctcgagatcgatcagaacaccttcctgctgctggagggcaacctgaagagaatctttgctactcctattggatatactaccttcagggagttccagaacgtggtgttcaattgcgcacaggggcagcaggaactggccaacttcctgttcgagatgctcatcaatggcaaactgctgcaggagctgccagctggccaaaagcagagcgcccagtctctcatcgtgcagttcatgatgcctatcagggtggccaaagacatccatgagaggggcgagtttatcaatttcatcacttccgatatgctggcccagcaggagagatgcgtgttcctgaatcggctgagcagggtcgatggacaggaattcctgctgatgaccgacgtgcaaaatacctgccacctgatcagacacctgctgagcagactcctggaggcccagaagaacccaatcggggaaaagaatctgcaggagatccaggaagacctggactctctgagagctcacttcgaggagctgaccaaaagcgtg

SEQ ID NO: 716 - RNA, 546 nt, synthetic construct
  source 1..546: mol_type = other RNA
accacaaagccaaaaacactggagatcgaccagaatacattcctgctgctggaagggaatctgaaacggatcttcgccacccctatcggctataccacattccgcgaattccagaacgtcgtgttcaactgcgctcaaggccagcaggaactggccaacttcctgttcgaaatgctgatcaacggcaagctgctgcaggagctgcctgccggacagaaacagtctgcacagtctctgattgtgcagtttatgatgccaatcagggtggccaaggacatccatgagcgcggggagttcattaattttatcacctccgacatgctggcccagcaggaaaggtgtgtgtttctgaatcgcctgtccagagtggacggccaggaatttctgctgatgactgacgtgcagaacacctgtcacctgatcaggcacctgctgtctcggctgctggaggcacagaagaatcctatcggcgagaagaacctgcaggagattcaggaagacctggactctctccgggcccatttcgaggagctgactaagtctgtc

SEQ ID NO: 717 - RNA, 546 nt, synthetic construct
  source 1..546: mol_type = other RNA
accaccaaaccaaaaaccctggagattgaccagaatactttcctgctgctggaaggaaacctgaagaggatttttgccacaccaatcgggtatacaacattccgggagtttcagaacgtggtgtttaattccgctcaggggcagcaggagctggctaacttcctgttcgagatgctgatcaacggcaagctgctgcaagaactgccagccggccagaagcagagcgctcagtctctgattgtgcagtttatgatgccaattcgcgtggccaaagatatccacgagcgcggcgagttcattaatttcatcacctccgatatgctggcccagcaggagaggtccgtgttcctgaacagactgtccagagtggatgggcaggagtttctgctgatgaccgacgtgcagaacacttcccacctgatccgccacctgctgagcaggctgctcgaagcacagaagaatcctatcggagagaagaatctgcaggagatccaggaggatctggatagcctgcgggcacacttcgaggagctgaccaagagcgtc

SEQ ID NO: 718 - RNA, 546 nt, synthetic construct
  source 1..546: mol_type = other RNA
accaccaagccaaagacactggaaattgaccagaacacatttctgctgctcgagggcaacctgaaaagaatttttgccactccaatcggctacaccacattcagggagtttcagaatgtggtgttcaattccgcccaggggcaacaggaactggcaaatttcctgtttgagatgctgatcaacgggaagctgctgcaggagctgccagctggccagaagcagtccgctcagagcctgatcgtgcagttcatgatgcccattagagtggctaaggacatccacgagcgcggcgaattcatcaacttcatcacatcagatatgctggctcagcaggagcggagcgtgttcctgaatcggctgtccagggtggatgggcaggagtttctgctgatgacagacgtccagaacaccagccacctgatccgacacctgctgtccagactgctggaggcccaaaagaaccccatcggggagaaaaacctgcaggagattcaggaggacctggacagcctgcgggcccacttcgaggaactcaccaagtctgtg

SEQ ID NO: 719 - RNA, 465 nt, synthetic construct
  source 1..465: mol_type = other RNA
gatagtgctaggcctcggaagtccagtttcggctttgtgccattctacagcgacgaggagattcagcaggcctttgtcgaggactttgattccaaggaggagcagctgtataagacatccgcccagagcactagcttcagaaacattaccttcgcaactgactcctactccatcaagggcgaagacaacctgaccatcctggccagcctggtgaggcacctgcacaaaagcccaaaagctaccctgtacattgagggacacactgacgaaaggggagccgcagcctataacctggctctgggagccagacgcgcaaacgctgtgaaacagtacctgatcaagcaggggatcgccgccgataggctgttcacaatttcctatgggaaagaacacccagtgcatccaggccacaatgagctggcttggcagcagaatcggaggactgagttcaagatccacgcccgc

SEQ ID NO: 720 - RNA, 465 nt, synthetic construct
  source 1..465: mol_type = other RNA
gactcagctcgccctaggaaatctagctttggatttgtgcctttctatagcgacgaggaaattcagcaggcattcgtggaggactttgatagtaaggaggaacagctgtacaaaacctccgcccagagcacatccttcaggaatatcaccttcgccaccgactcctactcaattaagggagaggataatctgacaattctggcatctctggtccggcacctgcacaaaagccctaaagccacactgtatatcgagggacacaccgacgagagaggagccgccgcatacaacctggctctcggggctagaagggccaatgcagtcaagcagtacctgatcaagcagggaatcgccgccgaccggctgtttaccatcagctacggaaaagagcaccctgtgcatcctggccacaatgaactcgcatggcagcagaacaggagaactgagtttaagatccacgccaga

SEQ ID NO: 721 - RNA, 465 nt, synthetic construct
  source 1..465: mol_type = other RNA
gacagcgcacggcctagaaagtccagcttcgggtttgtgcccttctatagcgacgaagagatccagcaggccttcgtggaggacttcgatagcaaggaggaacagctgtacaaaacctccgcccagtccacatccttccggcagatcacctttgctaccgatagctacagcatcaagggcgaagataacctggccatcctggcatccctggtgagacacctgcacaaaagccctaaggctaccctctacatcgagggacacacagacgaaaggggagctgccgcatataatctggctctgggcgcaagacgcgccaatgctgtgaaacagtacctgatcaaacagggcatcgccgctgaccgcctgttcacaattagctacggaaaagagcaccctgtgcatcccgggcataatgagctcgcctggcagcagaataggcggacagagttcaaaattcacgcccgc

SEQ ID NO: 722 - RNA, 465 nt, synthetic construct
  source 1..465: mol_type = other RNA
gacagcgcaaggcccaggaaatccagcttcggattcgtgcccttctacagcgacgaggagatccagcaggctttcgtcgaagactttgattctaaggaggaacagctgtataagacatccgcacagtccacttccttcaggcagatcaccttcgctaccgactcttactccatcaaaggagaagataacctggccattctggcatccctggtgagacacctgcacaagtcccctaaagctacactgtacatcgaaggccatacagacgagagaggagccgcagcctataacctggcactgggagccaggcgcgcaaatgcagtgaagcagtacctgatcaagcaggggattgccgccgataggctgttcaccatcagctatgggaaggagcacccagtgcatccaggccataacgaactggcatggcagcaaaataggcgcaccgagtttaagatccatgccagg

SEQ ID NO: 723 - RNA, 2856 nt, synthetic construct
  source 1..2856: mol_type = other RNA
tcttcttttcaagagaaagatgccgataccctgccaggcaaggtggagcagtctaccctgttttccgtgacaaacccagtggtgttccagggagttgaccagcaggaccaggtgtcctctcagggcctgatttgcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcatgtgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaactgcgccgagctggtgtttaagggaaactgcgccatcgggactgaagacaagggctccctgggaggaggagccatcagctctctgggcacagtgctcctgcagggcaaccatggaattacctgtgataaaaatgagtctgccagccagggaggagccatcttcggcaaaaactgtcagatcagcgacaacgaaggacctgtggtgttcagggacagcacagcctgtctgggcggaggggcaattgcagcccaggagatcgtgtctatccagaacaaccaggctggaatctcctttgaagggggcaaggctagcttcggcggcggcatcgcctgcgagtcattcagctccgctggcggagccagcgtcttgggcgccattgatatcagcaagaacctcggcgccattagctttagtaggactctgtgtaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagtgttctgaagaggaagccactctcctgggctgttgcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagtgtgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctatttgcacacaaaacctgactatttcccagaacaccggcaacgtgctgttctacaataacgtcgcttgtagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagtgcattcacgtgcagcagggcagtctggagctgctgaacggagccaccctgtgcagctatggcttcaaacaggacgcaggcgctaaactggtcctggcttctgggtccaagctgaaaatcctg

SEQ ID NO: 724 - RNA, 2856 nt, synthetic construct
  source 1..2856: mol_type = other RNA
tcctcctttcaagaaaaggatgctgataccctgcctggaaaagtggagcagtccaccctgttcagtgtgacaaaccccgtcgtgttccagggcgtcgaccagcaggatcaggtgtcctcccagggcctgatttgctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgcctgtgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaactgtgccgagctggtgtttaaagggaactgcgccattggcactgaggataagggaagtctggggggcggcgccatctccagcctggggacagtgctgctgcaggggaaccacgggattacctgcgacaaaaacgaaagcgcatcccagggcggagccatttttggcaagaactgccagatttctgataacgagggccccgttgttttcagggacagcaccgcttgtctgggcggcggcgcaattgctgcacaggagatcgtgtctattcagaacaaccaggcaggaatttcctttgaaggcggaaaggccagctttggcggcggcattgcatgcgagtccttctcctccgccggaggcgccagcgtgctgggcgcaattgatatctctaagaatctgggagcaatctccttctctcggactctgtgtactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagtgtagcgaggaggaggctactctgctgggctgttgcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagtgcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccatttgcacacagaatctgactatttcccagaacactggaaacgtgctgttttacaacaacgtggcatgctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagtgtattcatgtgcagcaggggagcctggaactgctgaatggcgccacactgtgttcctacggcttcaagcaggacgctggggctaagctggtgctggccagcggatctaaactgaaaatcctc

SEQ ID NO: 725 - RNA, 2856 nt, synthetic construct
  source 1..2856: mol_type = other RNA
tcttcttttcaagagaaagatgccgataccctgccaggcaaggtggagcagtctaccctgttttccgtgacaaacccagtggtgttccagggagttgaccagcaggaccaggtgtcctctcagggcctgattagcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcaagcgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaacagcgccgagctggtgtttaagggaaacagcgccatcgggactgaagacaagggctccctgggaggaggagccatcagctctctgggcacagtgctcctgcagggcaaccatggaattaccagcgataaaaatgagtctgccagccagggaggagccatcttcggcaaaaacagccagatcagcgacaacgaaggacctgtggtgttcagggacagcacagccagcctgggcggaggggcaattgcagcccaggagatcgtgtctatccagaacaaccaggctggaatctcctttgaagggggcaaggctagcttcggcggcggcatcgccagcgagtcattcagctccgctggcggagccagcgtcttgggcgccattgatatcagcaagaacctcggcgccattagctttagtaggactctgagcaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagagctctgaagaggaagccactctcctgggcagcagcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagagcgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctattagcacacaaaacctgactatttcccagaacaccggcaacgtgctgttctacaataacgtcgctagcagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagagcattcacgtgcagcagggcagtctggagctgctgaacggagccaccctgagcagctatggcttcaaacaggacgcaggcgctaaactggtcctggcttctgggtccaagctgaaaatcctg

SEQ ID NO: 726 - RNA, 2856 nt, synthetic construct
  source 1..2856: mol_type = other RNA
tcctcctttcaagaaaaggatgctgataccctgcctggaaaagtggagcagtccaccctgttcagtgtgacaaaccccgtcgtgttccagggcgtcgaccagcaggatcaggtgtcctcccagggcctgattagctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgccagcgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaacagcgccgagctggtgtttaaagggaacagcgccattggcactgaggataagggaagtctggggggcggcgccatctccagcctggggacagtgctgctgcaggggaaccacgggattaccagcgacaaaaacgaaagcgcatcccagggcggagccatttttggcaagaacagccagatttctgataacgagggccccgttgttttcagggacagcaccgctagcctgggcggcggcgcaattgctgcacaggagatcgtgtctattcagaacaaccaggcaggaatttcctttgaaggcggaaaggccagctttggcggcggcattgcaagcgagtccttctcctccgccggaggcgccagcgtgctgggcgcaattgatatctctaagaatctgggagcaatctccttctctcggactctgagcactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagagcagcgaggaggaggctactctgctgggcagcagcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagagcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccattagcacacagaatctgactatttcccagaacactggaaacgtgctgttttacaacaacgtggcaagctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagagcattcatgtgcagcaggggagcctggaactgctgaatggcgccacactgagctcctacggcttcaagcaggacgctggggctaagctggtgctggccagcggatctaaactgaaaatcctc

SEQ ID NO: 727 - RNA, 3384 nt, synthetic construct
  source 1..3384: mol_type = other RNA
tcttcttttcaagagaaagatgccgataccctgccaggcaaggtggagcagtctaccctgttttccgtgacaaacccagtggtgttccagggagttgaccagcaggaccaggtgtcctctcagggcctgatttgcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcatgtgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaactgcgccgagctggtgtttaagggaaactgcgccatcgggactgaagacaagggctccctgggaggaggagccatcagctctctgggcacagtgctcctgcagggcaaccatggaattacctgtgataaaaatgagtctgccagccagggaggagccatcttcggcaaaaactgtcagatcagcgacaacgaaggacctgtggtgttcagggacagcacagcctgtctgggcggaggggcaattgcagcccaggagatcgtgtctatccagaacaaccaggctggaatctcctttgaagggggcaaggctagcttcggcggcggcatcgcctgcgagtcattcagctccgctggcggagccagcgtcttgggcgccattgatatcagcaagaacctcggcgccattagctttagtaggactctgtgtaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagtgttctgaagaggaagccactctcctgggctgttgcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagtgtgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctatttgcacacaaaacctgactatttcccagaacaccggcaacgtgctgttctacaataacgtcgcttgtagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagtgcattcacgtgcagcagggcagtctggagctgctgaacggagccaccctgtgcagctatggcttcaaacaggacgcaggcgctaaactggtcctggcttctgggtccaagctgaaaatcctggacagcggaaccccagtgcagggacatgctgttagtaaacctgaggccgagatcgagtccagcagcgagcctgaaggcgcccactctctgtggatcgctaagaacgcacagaccacagtgcctatggtggacattcacacgatctctgtggacctggccagcttctcctctagccagcaggagggcacagtggaggcacctcaggttatcgtgcccggaggctcttatgtgagatccggagagctgaatctggaactggttaacaccactggcacagggtatgagaatcacgccctgctgaagaacgaggctaaggtgcccctgatgtcctttgtggccagctctgatgaggccagcgcagagatcagcaacctgtctgtgagcgacctgcaaatccgggtggtgaccccagagatcgaagaagacacctacggccatatgggcgactggtccgaagcaaaaatccaggatggaactctggtgattaactggaaccccaccggatatcggctggacccccagaaggcc

SEQ ID NO: 728 - RNA, 3384 nt, synthetic construct
  source 1..3384: mol_type = other RNA
tcctcctttcaagaaaaggatgctgataccctgcctggaaaagtggagcagtccaccctgttcagtgtgacaaaccccgtcgtgttccagggcgtcgaccagcaggatcaggtgtcctcccagggcctgatttgctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgcctgtgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaactgtgccgagctggtgtttaaagggaactgcgccattggcactgaggataagggaagtctggggggcggcgccatctccagcctggggacagtgctgctgcaggggaaccacgggattacctgcgacaaaaacgaaagcgcatcccagggcggagccatttttggcaagaactgccagatttctgataacgagggccccgttgttttcagggacagcaccgcttgtctgggcggcggcgcaattgctgcacaggagatcgtgtctattcagaacaaccaggcaggaatttcctttgaaggcggaaaggccagctttggcggcggcattgcatgcgagtccttctcctccgccggaggcgccagcgtgctgggcgcaattgatatctctaagaatctgggagcaatctccttctctcggactctgtgtactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagtgtagcgaggaggaggctactctgctgggctgttgcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagtgcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccatttgcacacagaatctgactatttcccagaacactggaaacgtgctgttttacaacaacgtggcatgctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagtgtattcatgtgcagcaggggagcctggaactgctgaatggcgccacactgtgttcctacggcttcaagcaggacgctggggctaagctggtgctggccagcggatctaaactgaaaatcctcgactccggaacccctgtgcaaggccatgctgtgagcaagcccgaggcagagatcgaatcctcttctgaacccgagggcgcccattccctgtggatcgccaaaaatgcacagaccacagtgcccatggtggacattcataccattagcgtcgacctggccagcttttccagctcacagcaggaaggcaccgtcgaggctccccaagtgattgtgcctggaggaagctacgtgcggagcggagagctgaacctggagctggtgaacaccactgggaccggatatgaaaaccacgccctgctcaagaacgaagccaaggtccctctgatgtcctttgtggcctccagcgatgaggcatccgcagagatcagcaatctgagcgtgagcgatctgcagattagggtggtgacacctgagattgaggaggacacttacggccacatgggagactggtccgaagctaagatccaggatggcaccctggtgatcaattggaaccctactggatatagactggacccacagaaggca

SEQ ID NO: 729 - RNA, 3384 nt, synthetic construct
  source 1..3384: mol_type = other RNA
tcttcttttcaagagaaagatgccgataccctgccaggcaaggtggagcagtctaccctgttttccgtgacaaacccagtggtgttccagggagttgaccagcaggaccaggtgtcctctcagggcctgattagcagctttacttccagcaacctggatagcccacgcgacggcgaatccttcctgggaatcgctttcgtgggcgactcttccaaagctggcatcacactgaccgatgtgaaggcctctctgagcggggcagccctctactctacagaggacctgatttttgagaagatcaaggggggcctggagtttgcctcttgttctagcctggaacagggaggcgcaagcgccgcccagagcattctgatccacgattgccagggcctgcaggtgaagcactgtacaaccgccgtgaacgcagagggatccagcgcaaatgaccacctcggctttggaggaggggccttctttgtgactggatccctgtccggagagaagtcactgtatatgccagcaggcgacatggtggtggctaactgcgacggggccatcagctttgagggcaattccgctaatttcgccaacggcggggctatcgctgcttctggcaaggtcctgtttgtggcaaatgataagaagacatccttcattgaaaatagggccctgagcggcggggctatcgccgcatccagcgacatcgccttccagaacagcgccgagctggtgtttaagggaaacagcgccatcgggactgaagacaagggctccctgggaggaggagccatcagctctctgggcacagtgctcctgcagggcaaccatggaattaccagcgataaaaatgagtctgccagccagggaggagccatcttcggcaaaaacagccagatcagcgacaacgaaggacctgtggtgttcagggacagcacagccagcctgggcggaggggcaattgcagcccaggagatcgtgtctatccagaacaaccaggctggaatctcctttgaagggggcaaggctagcttcggcggcggcatcgccagcgagtcattcagctccgctggcggagccagcgtcttgggcgccattgatatcagcaagaacctcggcgccattagctttagtaggactctgagcaccacctctgacctgggccagatggagtatcagggcggaggcgcactcttcggcgagaatatctccctgagcgagaacgctggcgtgctgacctttaaggacaacattgtgaagacatttgccagcaatggaaagatcctgggcgggggagctatcctggcaacaggcaaagtggagattactaataactccggcgggatctccttcaccggaaacgctcgcgcaccccaagccctgcccactcaggaggaatttccactgttctctaagaaggaggggaggccactgagcagcggatactctggaggcggagccatcctgggcagggaagtggccattctgcacaacgccgccgtggtgttcgagcagaataggctgcagagctctgaagaggaagccactctcctgggcagcagcggaggcggcgcagtgcatggcatggatagcacctctatcgtgggcaattcctccgtgaggtttggaaataactatgccatgggccagggagtcagcggcggggctctgctgtccaagacagtgcagctggccggcaacggctccgtggacttctcccgcaacatcgcatctctgggcggaggcgctctgcaggcttccgaaggcaactgcgaattggtggataacggatacgtgctgttccgcgacaacagaggaagagtgtatggcggagccattagctgtctgagaggagatgtcgtgatcagcggcaataagggcagggtggaattcaaggacaacatcgctacacggctgtacgtggaggagactgttgagaaggtggaggaagtggaaccagccccagaacagaaggacaataacgagctgtcctttctgggctccgctgagcagtcttttattactgccgccaatcaggccctgttcgccagcgaagacggggacctgtcccccgagtccagcatcagctctgaggagctggctaaacggcgcgagagcgctggcggcgccatcttcgccaaaagagtgaggatcgtcgacaatcaggaggctgtggtgttctccaacaatttctccgacatctatggaggcgccattttcaccgggtccctgagggaggaggataaactggacggacagatccccgaggtgctgattagcggcaacgccggcgatgtggtgttcagtgggaacagcagcaagagagacgagcacctgcctcacaccggcggcggcgctattagcacacaaaacctgactatttcccagaacaccggcaacgtgctgttctacaataacgtcgctagcagcggaggggcagtgaggattgaggatcacggaaacgtgctgctggaggcctttggcggagatattgtctttaagggaaactcctccttcagagcccagggatccgacgccatctactttgcaggaaaggagtctcacatcaccgccctgaatgccactgagggccacgccatcgtgttccacgatgcactggtgttcgagaacctggaggagcggaagtcagcagaagtgctgctgatcaatagcagggaaaatcctggctataccgggagcatcaggttcctggaggctgaaagcaaggtcccccagagcattcacgtgcagcagggcagtctggagctgctgaacggagccaccctgagcagctatggcttcaaacaggacgcaggcgctaaactggtcctggcttctgggtccaagctgaaaatcctggacagcggaaccccagtgcagggacatgctgttagtaaacctgaggccgagatcgagtccagcagcgagcctgaaggcgcccactctctgtggatcgctaagaacgcacagaccacagtgcctatggtggacattcacacgatctctgtggacctggccagcttctcctctagccagcaggagggcacagtggaggcacctcaggttatcgtgcccggaggctcttatgtgagatccggagagctgaatctggaactggttaacaccactggcacagggtatgagaatcacgccctgctgaagaacgaggctaaggtgcccctgatgtcctttgtggccagctctgatgaggccagcgcagagatcagcaacctgtctgtgagcgacctgcaaatccgggtggtgaccccagagatcgaagaagacacctacggccatatgggcgactggtccgaagcaaaaatccaggatggaactctggtgattaactggaaccccaccggatatcggctggacccccagaaggcc

SEQ ID NO: 730 - RNA, 3384 nt, synthetic construct
  source 1..3384: mol_type = other RNA
tcctcctttcaagaaaaggatgctgataccctgcctggaaaagtggagcagtccaccctgttcagtgtgacaaaccccgtcgtgttccagggcgtcgaccagcaggatcaggtgtcctcccagggcctgattagctctttcactagctctaacctggatagcccacgcgacggcgagagcttcctcggaatcgccttcgtgggggacagcagtaaggctggcatcaccctgaccgatgtgaaagccagcctgagcggagcagccctgtactccactgaggacctgatctttgaaaagattaaggggggactggaattcgcttcttgcagcagtctggagcagggcggcgccagcgctgcacagtctatcctcatccacgattgccagggactgcaggtgaaacattgcaccacagcagtgaacgctgaaggcagcagcgcaaacgatcacctggggtttgggggcggagctttctttgtgacaggctccctgtccggcgagaagtccctgtacatgcccgctggagacatggtggtggccaactgcgatggagccattagcttcgaagggaacagcgctaacttcgccaacggcggcgccattgcagcctctggcaaagtcctgttcgttgccaacgacaagaagacttccttcatcgagaacagagccctctccggcggcgctatcgccgctagtagcgacatcgcctttcagaacagcgccgagctggtgtttaaagggaacagcgccattggcactgaggataagggaagtctggggggcggcgccatctccagcctggggacagtgctgctgcaggggaaccacgggattaccagcgacaaaaacgaaagcgcatcccagggcggagccatttttggcaagaacagccagatttctgataacgagggccccgttgttttcagggacagcaccgctagcctgggcggcggcgcaattgctgcacaggagatcgtgtctattcagaacaaccaggcaggaatttcctttgaaggcggaaaggccagctttggcggcggcattgcaagcgagtccttctcctccgccggaggcgccagcgtgctgggcgcaattgatatctctaagaatctgggagcaatctccttctctcggactctgagcactacctccgacctgggccagatggagtaccagggaggaggagccctgttcggcgagaatatttctctgtctgaaaacgctggggtgctgaccttcaaagataacatcgtgaagacatttgccagcaacggaaagattctgggggggggggccatcctggctaccggcaaggtggagatcaccaataacagtggcggcatcagctttactgggaatgcaagggcaccccaggctctgcctactcaggaagaatttcccctgttcagcaagaaggaggggcgcccactgagctctggctacagtggaggcggcgccattctgggcagagaggttgccatcctgcacaatgctgccgtggtctttgagcagaataggctgcagagcagcgaggaggaggctactctgctgggcagcagcggagggggcgcagtgcacggcatggattcaacatccatcgtgggaaactccagcgtgaggttcgggaacaactacgccatgggacagggcgtgagcgggggagccctgctgtctaaaacagttcagctggccggcaacggaagcgtggatttttccagaaacattgcatctctgggcggcggcgctctgcaggcatccgagggcaattgcgagctggtggataatggctacgtgctgttcagggataaccggggccgcgtctatggaggcgctatcagctgtctccgcggcgacgtcgtgatcagcggaaacaaaggccgggtcgaattcaaggacaatatcgccacacggctctatgtcgaggaaacagtggagaaggtggaggaggtggagcctgccccagaacagaaggacaacaacgagctgtcctttctggggtccgccgaacagtcctttatcactgcagccaaccaggcactgtttgcctctgaggacggcgacctgtctcccgagagctccatttcttcagaggagctggccaagaggagagagagcgccgggggcgctattttcgctaagagagtgcggattgtggacaatcaggaggcagttgtcttcagtaataacttttccgatatctacggaggcgccatcttcaccggcagcctcagagaggaggacaagctggacggccagatcccagaggtgctgatcagcgggaacgccggagacgtggtgttcagtggcaattcctctaagagagatgaacacctgcctcacacaggaggaggcgccattagcacacagaatctgactatttcccagaacactggaaacgtgctgttttacaacaacgtggcaagctctggaggagccgtgagaatcgaggatcatgggaacgtgctgctggaagccttcggaggagacatcgtgttcaaggggaattcctcctttagagctcagggctccgatgccatctacttcgccgggaaggagagccatatcaccgccctgaacgcaacagaaggccacgccatagtcttccacgacgctctggtgttcgaaaacctggaggagcggaagtccgcagaagtgctgctgatcaactcccgcgagaacccaggctatacagggtccattcgcttcctggaggccgaatccaaggtccctcagagcattcatgtgcagcaggggagcctggaactgctgaatggcgccacactgagctcctacggcttcaagcaggacgctggggctaagctggtgctggccagcggatctaaactgaaaatcctcgactccggaacccctgtgcaaggccatgctgtgagcaagcccgaggcagagatcgaatcctcttctgaacccgagggcgcccattccctgtggatcgccaaaaatgcacagaccacagtgcccatggtggacattcataccattagcgtcgacctggccagcttttccagctcacagcaggaaggcaccgtcgaggctccccaagtgattgtgcctggaggaagctacgtgcggagcggagagctgaacctggagctggtgaacaccactgggaccggatatgaaaaccacgccctgctcaagaacgaagccaaggtccctctgatgtcctttgtggcctccagcgatgaggcatccgcagagatcagcaatctgagcgtgagcgatctgcagattagggtggtgacacctgagattgaggaggacacttacggccacatgggagactggtccgaagctaagatccaggatggcaccctggtgatcaattggaaccctactggatatagactggacccacagaaggca

SEQ ID NO: 731 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctgtaa

SEQ ID NO: 732 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 733 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 734 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 735 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 736 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 737 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctgtaa

SEQ ID NO: 738 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 739 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 740 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 741 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 742 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 743 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctgtaa

SEQ ID NO: 744 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 745 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 746 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 747 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 748 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 749 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctgtaa

SEQ ID NO: 750 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctgtaa

SEQ ID NO: 751 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 752 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 753 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 754 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 755 - RNA, 2859 nt, synthetic construct
  source 1..2859: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgaggaactggccaagagaaaggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctgtaa

SEQ ID NO: 756 - RNA, 2859 nt, synthetic construct
  source 1..2859: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgaggaactggcaaagagaaaggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctgtaa

SEQ ID NO: 757 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgcgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgcctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgctgcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgaggaactggccaagagaaaggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgcacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgcattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 758 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgccagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgcgagtccttttctagcgcaggaggagcttccgtgctgggcgcaattgatatctctaagaacctgggagccatctcctttagccggaccctgtgcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgctccgaggaagaggccaccctgctgggatgctgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgaggaactggcaaagagaaaggagtgcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 759 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatctgcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcatgtgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaactgcgccgagctggtgtttaaaggcaactgtgccatcggcacagaggataaggggagcctgggaggcggagccatctcctccctggggacagtgctgctgcagggcaaccacggcatcacttgcgataagaacgagtccgcctctcaggggggggccatcttcggaaagaattgccaaattagcgacaacgagggccctgtggtgtttagagattctacagcctgtctgggcggaggcgccattgccgcccaggaaattgtgtccattcagaacaaccaggcagggatttcctttgagggcgggaaggcatctttcggcgggggcatcgcctgcgagagcttctctagtgccggaggagcttctgtgctgggcgctatcgatatctccaagaatctgggagcaatctccttttcccggaccctgtgcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagtgctccgaggaggaggccacactgctgggatgttgtgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggctccgccgagaactccttcattactgctgcaaatcaggcactgttcgcctccgaagacggcgacctgagccctgagagctccatttcctccgacgaactggccaagagaagggaatgcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccatttgtacacagaacctgacaatcagccagaacaccggcaacgtgctgttttacaacaacgtggcctgcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagtgtattcacgtgcagcagggatccctggagctgctgaacggggccaccctgtgcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 760 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgatttgcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgcttgtgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaactgcgctgagctggtgttcaagggaaactgcgccatcggaacagaggacaaggggtcactcggaggcggggctatcagctccctgggaaccgtgctgctgcagggcaatcacggaattacctgcgacaaaaacgagagcgccagccagggaggcgccatctttggaaaaaattgtcagatctctgacaacgagggacccgtggtgttcagagattctactgcttgcctgggaggcggtgccatcgctgcccaggaaattgtgagcatccagaataatcaggctggcatcagctttgagggaggaaaagctagcttcggaggcggcatcgcatgtgagtccttttctagcgcaggaggagcttccgtgctgggcgcaattgatatctctaagaacctgggagccatctcctttagccggaccctgtgtacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagtgttccgaggaagaggccaccctgctgggatgttgcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggtccgcagagaactctttcatcaccgcagccaatcaggcactgttcgcttctgaggatggggacctgagcccagagagctccatcagcagtgacgaactggcaaagagacgggagtgtgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatctgcacccagaatctgaccatcagtcagaataccggcaacgtgctgttttacaacaatgtggcatgttccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagtgcatccacgtgcagcagggcagcctggaactgctgaacggggcaaccctgtgctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 761 - RNA, 3387 nt, synthetic construct
  source 1..3387: mol_type = other RNA
tcctcttttcaggagaaggatgccgataccctgccagggaaggtggagcagagcaccctgttctccgtgacaaatcctgttgtgtttcagggcgtcgaccagcaggatcaggtgtcttcccagggcctgatcagcagttttacctccagcaacctggactcccccagagacggggagagctttctgggcatcgcttttgtgggagatagcagcaaagctggcatcacactgactgacgtgaaagcctccctctctggcgcagccctgtacagcactgaggacctgatctttgaaaaaatcaagggcggactggaattcgcctcctgtagcagcctggaacagggcggcgcaagcgcagctcagagcatcctcatccacgactgccagggactgcaggtgaagcactgcacaactgccgtgaacgctgaaggctcctctgccaatgaccacctgggcttcgggggaggcgccttctttgttaccggctccctgagcggcgagaagtccctgtacatgcctgccggcgacatggtggtcgccaactgtgacggagcaattagcttcgaaggaaactccgccaacttcgctaacgggggcgcaatcgctgccagcgggaaggtgctgtttgtggccaacgataagaagactagctttatcgagaacagagccctgagcggaggggcaatcgctgcttctagcgatatcgcatttcagaacagcgccgagctggtgtttaaaggcaacagcgccatcggcacagaggataaggggagcctgggaggcggagccatctcctccctggggacagtgctgctgcagggcaaccacggcatcactagcgataagaacgagtccgcctctcaggggggggccatcttcggaaagaatagccaaattagcgacaacgagggccctgtggtgtttagagattctacagccagcctgggcggaggcgccattgccgcccaggaaattgtgtccattcagaacaaccaggcagggatttcctttgagggcgggaaggcatctttcggcgggggcatcgccagcgagagcttctctagtgccggaggagcttctgtgctgggcgctatcgatatctccaagaatctgggagcaatctccttttcccggaccctgagcactaccagcgacctgggccagatggagtaccagggaggcggagcactcttcggcgagaatatttccctgagcgaaaatgctggggttctgaccttcaaggacaatattgtgaagacatttgcctccaacggcaagattctgggcggaggcgccatcctggccacaggaaaggtggagatcaccaacaactccgggggaatttctttcaccggcaatgcccgcgcaccacaggcactgcctacacaggaggagtttccactgtttagcaagaaggagggcaggcctctgagctctggctatagcggaggaggcgccattctgggcagagaggtggccatcctgcacaatgcagctgtggtgttcgagcagaatagactgcagagctccgaggaggaggccacactgctgggaagcagcgggggaggcgccgtgcatggcatggattctactagcatcgtgggcaattccagcgtgcggtttgggaataattacgctatgggccagggcgtgagcggcggcgccctgctgtccaaaacagtccagctggccggcaatggatccgtggacttcagccgcaacatcgcctctctgggcggcggagcactgcaggcatctgagggcaactgcgagctcgtggacaacggatatgtgctgttccgcgacaaccgcggccgcgtttatggcggagccatttcttgcctgcggggagacgtggtcattagcggcaataagggaagagtggagttcaaagacaacattgccaccagactctacgtggaagagactgtggagaaagtggaagaggtggagccagcacctgagcagaaagataacaacgaactgagcttcctgggcaccgccgagcagtccttcattactgctgcaaatcaggcactgttcgcctccgaagacggcgacctgagccctgagagctccatttcctccgacgaactggccaagagaagggaaagcgctggcggagctatcttcgcaaagcgggtgcggattgtggacaaccaggaagctgtggtgttcagcaacaactttagcgacatctatggcggcgccatcttcactggcagcctgagagaggaggacaagctggacggccagattccagaagtgctgatctccggcaacgccggggacgttgttttcagcgggaactcctctaagcgggacgaacatctgcctcacaccggcggcggcgccattagcacacagaacctgacaatcagccagaacaccggcaacgtgctgttttacaacaacgtggccagcagcggaggggctgtgcgcatcgaagatcatggcaatgtgctgctggaggcattcggaggagacatcgtgttcaaaggcaattctagcttccgggcccagggatctgacgccatctacttcgcaggcaaggagtctcacatcacagcactgaatgctaccgaaggacacgccatcgtcttccacgacgcactggtgttcgagaacctggaggagaggaagtctgcagaagtgctgctgattaacagccgcgagaatcctggctacaccggctctatcagatttctggaggcagagagcaaggtgccacagagcattcacgtgcagcagggatccctggagctgctgaacggggccaccctgagcagctacgggtttaagcaggatgctggggccaaactggtgctggctagcggaagcaagctcaagatcctggatagcggcacacccgtgcagggacatgccgtgtccaaacccgaagccgagatcgagtcttcttccgagcccgaaggagcccacagcctgtggatcgccaagaatgcccagaccacagtgcctatggtggatattcatacaatttcagtggacctggcatctttcagctcctctcagcaggagggaactgtcgaggctcctcaggtcattgtgcccggaggctcttacgtgaggtccggagagctcaacctggagctggtgaacactacaggcaccggctacgagaaccatgccctgctgaagaacgaagctaaggtgcctctgatgagcttcgtcgccagcagcgacgaggcctccgctgagatcagcaacctgagcgtgtccgatctgcagatcagggtggtgacaccagaaattgaggaggatacttacgggcatatgggcgactggagcgaggccaaaatccaggatgggacactcgtgattaactggaaccctactggatataggctggacccccagaaggcctaa

SEQ ID NO: 762 - RNA, 3387 nt, synthetic construct
  source 1..3387: mol_type = other RNA
tcctctttccaggagaaggacgctgacacactgcctggaaaggtggaacagtccaccctgttttctgtgacaaacccagtcgtgttccagggagtggatcagcaggatcaggtcagctcccagggactgattagcagttttacttcttccaacctggacagccctagagacggcgagtcttttctcggcatcgcattcgtgggagactccagcaaggccggcatcacactgaccgacgtgaaggcaagcctgtcaggagccgctctgtattctactgaggacctgatctttgagaagatcaaggggggactggagttcgccagctgctctagcctggaacaggggggcgctagcgccgctcagtccatcctgatccacgactgccagggcctgcaggtgaagcactgtacaactgctgttaacgccgagggcagcagtgcaaatgaccacctggggtttggaggaggagccttcttcgtgactggctctctgtccggcgagaagtccctgtacatgccagccggcgatatggtggtggctaattgtgacggggccatttcttttgaaggcaacagcgccaatttcgcaaacggcggggccattgccgcatccggaaaagtgctgtttgtggccaacgacaagaagacatcctttatcgagaatagagccctgtctggcggagccattgcagccagctccgacatcgcattccagaacagcgctgagctggtgttcaagggaaacagcgccatcggaacagaggacaaggggtcactcggaggcggggctatcagctccctgggaaccgtgctgctgcagggcaatcacggaattaccagcgacaaaaacgagagcgccagccagggaggcgccatctttggaaaaaatagccagatctctgacaacgagggacccgtggtgttcagagattctactgctagcctgggaggcggtgccatcgctgcccaggaaattgtgagcatccagaataatcaggctggcatcagctttgagggaggaaaagctagcttcggaggcggcatcgcaagcgagtccttttctagcgcaggaggagcttccgtgctgggcgcaattgatatctctaagaacctgggagccatctcctttagccggaccctgagcacaacctccgacctgggccagatggagtaccagggtgggggcgccctgttcggggaaaacatctctctgtccgagaacgctggcgtgctgactttcaaggataacattgtgaagactttcgctagcaatggaaagatcctggggggcggagctatcctggccaccggcaaggttgaaatcaccaacaattccggagggatcagcttcactggcaacgcacgggctccacaggccctgcctacacaggaggagttcccactgttcagcaaaaaggaaggcaggcctctgagctctggctactctggaggcggagccatcctgggacgggaagtggccatcctccacaatgcagccgtcgtgtttgaacagaatagactgcagagctccgaggaagaggccaccctgctgggaagcagcggaggcggggctgtgcatgggatggatagcactagcattgtgggcaactcttccgtgaggttcggcaacaattacgccatgggccagggggtgtccggcggcgccctgctgagcaagactgtgcagctggcaggcaatgggagtgtggacttctcccgcaatatcgcttctctgggcggcggcgccctgcaggcttctgagggaaactgtgagctcgtggataacggatacgtgctgtttcgggacaatcggggccgcgtctatggcggagctattagctgcctgagaggcgacgttgtcatctccggcaataagggccgggtggagtttaaggacaatattgccactcggctgtatgtcgaagagacagtggaaaaggtggaggaggtggagccagcccctgagcagaaggataataatgagctgtctttcctggggaccgcagagcagtctttcatcaccgcagccaatcaggcactgttcgcttctgaggatggggacctgagcccagagagctccatcagcagtgacgaactggcaaagagacgggagagcgccggcggggccattttcgcaaagagggtgcggatcgtcgataaccaggaggccgtggtgttctccaataatttcagcgacatctacggaggagcaatcttcacaggctccctgcgggaggaggataagctggatgggcagatccctgaggtgctgatcagcggcaatgctggggacgtggtgttctcaggaaactccagcaaaagggacgaacacctgccacataccggaggaggggcaatcagcacccagaatctgaccatcagtcagaataccggcaacgtgctgttttacaacaatgtggcaagctccggcggagctgtgcggattgaggatcacggcaacgtgctgctggaggcattcggcggcgacatcgtgtttaaaggaaattccagcttcagagctcaggggtctgacgctatctactttgctggcaaggaatcccatattaccgcactgaatgcaacagagggccacgccatcgtgtttcacgacgccctggtcttcgagaacctggaagagagaaagagcgccgaggtgctgctcatcaacagccgcgagaaccctggctataccggaagcatcagatttctggaggcagagtccaaggtgcctcagagcatccacgtgcagcagggcagcctggaactgctgaacggggcaaccctgagctcctatgggtttaagcaggatgccggcgctaaactggtgctcgcttccggctctaagctgaaaattctggactctggaaccccagtgcagggacacgccgtgtctaaacctgaggctgaaatcgagtccagcagcgagcctgaaggcgctcatagcctgtggattgcaaagaatgcccagactacagtgccaatggtggatatccacactatctccgtggacctggcctcctttagcagcagccagcaggaggggacagtggaggctccacaggtcatcgtgcccggggggagctacgtgagatctggagaactcaacctggagctggtgaatactaccgggactggatacgagaaccacgctctgctgaagaatgaggccaaggtgcctctgatgtcctttgtggccagttcagacgaggcctctgccgaaatcagcaacctgagcgtgagcgatctgcagattagagtcgtgacccccgagatcgaggaggatacatacgggcatatgggagactggtctgaggccaagatccaggacggaacactggtcattaactggaaccctactgggtatagactggatccccagaaggcctaa

SEQ ID NO: 763 - RNA, 1116 nt, synthetic construct
  source 1..1116: mol_type = other RNA
ctccccgtcggaaatcctgccgagccttcgctcatgatcgacgggatattgtgggaagggtttgggggcgatccctgcgacccctgcacgacttggtgcgacgcaatttcgatgcggatgggctattacggcgatttcgtattcgaccgcgtgctcaagactgacgtgaacaaggaattccagatgggcgacaagccgacctcaactaccggaaacgctaccgccccgactaccctgaccgcccgggaaaaccccgcctacggccggcacatgcaggatgccgagatgttcaccaacgccgcgtgcatggccctgaacatttgggacagattcgacgtgttctgcaccctgggtgcctcctccggataccttaagggaaacagcgcctcattcaacttagtgggactttttggagacaacgaaaaccaatccaccgtcaaaactaacagcgtgccaaacatgagcctggatcagagcgtggtggaattgtacaccgataccgcgttctcgtggagcgtgggagccagggcagcgctgtgggagtgtggctgcgccaccttgggcgcttccttccaatacgcgcagtccaagcctaaggtcgaggagcttaacgtcctgtgcaatgccgcggaattcactatcaacaagccgaagggttacgtgggacaggaatttcccctggccctgatcgcggggaccgacgccgccactggaaccaaggacgccagtattgactaccacgagtggcaggcgtcactggccctgtcgtaccgcctcaacatgttcaccccgtacattggcgtgaagtggagcagagcttccttcgacgccgacacgatccggattgcccagcctaagtccgccacagcgatcttcgacaccactaccctgaacccgaccatcgccggtgctggcgatgtgaaggcttccgccgagggacagctcggggacaccatgcagattgtctccctgcaactcaacaagatgaagtcccggaagtcgtgcggtatcgcagtgggaactaccatcgtggacgccgataagtacgccgtcaccgtggagactaggctcatcgacgaacgggctgcacacgtgaacgcacagttccgcttctaa

SEQ ID NO: 764 - RNA, 1116 nt, synthetic construct; identical to SEQ ID NO: 763
  source 1..1116: mol_type = other RNA

SEQ ID NO: 765 - RNA, 1116 nt, synthetic construct
  source 1..1116: mol_type = other RNA
ctccccgtcggaaatcctgccgagccttcgctcatgatcgacgggatattgtgggaagggtttgggggcgatccctgcgacccctgcgcgacttggtgcgacgcaatttcgatgcgggtgggctattacggcgatttcgtattcgaccgcgtgctcaagactgacgtgaacaaggaattccagatgggcgccaagccgaccacggataccggaaactccgccgccccgtccaccctgaccgcccgggaaaaccccgcctacggccggcacatgcaggatgccgagatgttcaccaacgccgcgtgcatggccctgaacatttgggacagattcgacgtgttctgcaccctgggtgccacttccggataccttaagggaaacagcgcctcattcaacttagtgggactttttggagacaacgaaaaccaaaagaccgtcaaagccgagagcgtgccaaacatgagcttcgatcagagcgtggtggaattgtacaccgataccaccttcgcgtggagcgtgggagccagggcagcgctgtgggagtgtggctgcgccaccttgggcgcttccttccaatacgcgcagtccaagcctaaggtcgaggagcttaacgtcctgtgcaatgccgcggaattcactatcaacaagccgaagggttacgtgggaaaagaatttcccctggacctgactgcggggaccgacgccgccactggaaccaaggacgccagtattgactaccacgagtggcaggcgtcactggccctgtcgtaccgcctcaacatgttcaccccgtacattggcgtgaagtggagcagagcttccttcgacgccgacacgatccggattgcccagcctaagtccgccacagcgatcttcgacaccactaccctgaacccgaccatcgccggtgctggcgatgtgaagactggagccgagggacagctcggggacaccatgcagattgtctccctgcaactcaacaagatgaagtcccggaagtcgtgcggtatcgcagtgggaactaccatcgtggacgccgataagtacgccgtcaccgtggagactaggctcatcgacgaacgggctgcacacgtgaacgcacagttccgcttctaa

SEQ ID NO: 766 - RNA, 1125 nt, synthetic construct
  source 1..1125: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 767 - RNA, 1083 nt, synthetic construct
  source 1..1083: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgggggcggaggaggcggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 768 - RNA, 1035 nt, synthetic construct
  source 1..1035: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcgggggcggaggaggcgggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattccaccatcaccaccatcaccatcatggagggtctggaggctctggaggatctgcatggagccacccccagtttgaaaagtga

SEQ ID NO: 769 - RNA, 1002 nt, synthetic construct
  source 1..1002: mol_type = other RNA
ctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatggggggcggaggaggcgggaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgggggaggcggagggagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggggcggaggaggcgggacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgggggcggaggaggcggggacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttcatcaccatcatcaccatcaccacggaggatctggcggatccggaggatctgcctggtctcacccacagttcgagaagtga

SEQ ID NO: 770 - RNA, 1194 nt, synthetic construct
  source 1..1194: mol_type = other RNA
ctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatgggggataagcccacaagcaccactgggaatgccaccgcccccacaaccctgacagctcgggaaaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgacaatgagaaccagagcacagtcaaaaccaactccgtgcccaatatgtccctggatcagagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggcaggagtttcctctggctctgattgccggcacagacgctgccacaggcacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgccaccgctatttttgacaccacaacactgaatcccaccattgctggggccggcgatgtgaaagccagcgctgagggacagctgggcgacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttcatcaccatcatcaccatcaccacggaggatctggcggatccggaggatctgcctggtctcacccacagttcgagaagtga

SEQ ID NO: 771 - RNA, 4677 nt, synthetic construct
  source 1..4677: mol_type = other RNA
tcatctgagaaagacatcaaatctacatgcagcaagttttccctgagcgtggtcgccgccatcctggcttccgtttccggacttgcctcctgtgtggatctgcacgccggaggccagagcgtgaatgaactggtgtatgtcgggccacaggctgtcctgctgctggaccagattagggacctctttgtgggctccaaagactctcaggccgagggccagtatagactcattgtgggggatccttccagctttcaggagaaggacgctgacactctgcccggcaaagtggaacagtctaccctgttctccgtgaccaaccccgtcgtcttccagggggtggaccagcaggaccaggtttctagccagggcctgatttgctccttcaccagctccaacctggacagtcctcgcgatggcgagtccttcctggggatcgcctttgtgggagactcctctaaggccggcatcactctgacagatgtgaaagcctccctgtccggcgccgctctgtacagcactgaggacctgatcttcgagaagattaagggcgggctggagtttgcctcctgtagttccctggagcagggaggcgcttgcgccgcccagtccatcttgattcatgattgtcagggactgcaggttaaacactgtaccacagcagtgaatgctgagggctcctctgccaatgaccatctgggctttgggggaggagcattcttcgtgacagggagcctgtccggcgaaaaaagcctgtacatgccagccggcgatatggtcgtggccaattgcgatggagcaatctcctttgaggggaattccgccaatttcgccaacggcggcgccatcgccgcatccggcaaggtgctgtttgtggcaaacgacaagaagaccagcttcattgagaaccgcgccctgtcaggcggagccatcgccgcatcctctgacatcgcctttcagaattgtgcagagctggtgttcaagggcaactgcgcaatcggcaccgaggataaaggaagcctggggggaggcgctatttcctcactgggcactgtgctgctccaggggaatcacggcattacctgcgataaaaacgaaagtgccagccagggcggcgcaatcttcggcaaaaactgtcagatttccgataacgagggcccagtcgtgttcagagattccacagcttgcctgggcgggggagccattgccgctcaggagatcgtgagcatccagaataatcaggctgggatctccttcgagggcgggaaggccagctttggcggcggcatcgcttgtgagtccttctccagcgccggaggcgcttctgtcctgggcgcaatcgatatctccaagaacctgggcgccatttctttcagcaggactctgtgcactacctccgacctgggccaaatggagtaccagggaggaggcgccctgttcggcgaaaatatttccctgtccgagaatgccggcgtgctgactttcaaggacaatattgtgaaaacctttgcctctaatggaaagatcctgggaggcggagctattctggccaccggaaaagtggagatcacaaataactccggaggcatttctttcacagggaatgccagagccccacaggccctgcctacccaggaagagttcccactgttctccaagaaggaaggccgcccactgtcaagcggatacagcggcggaggcgctatcctggggagagaggtggctattctgcataacgctgctgtggtgttcgagcagaatagactccagtgtagcgaggaggaagcaaccctgctggggtgttgcgggggaggagccgtgcacggaatggactccactagcattgtgggaaactcaagcgtccgctttggcaacaactacgctatgggacagggcgtgagcggaggcgcactcctgtctaagacagtgcagctggccggcaatggctctgtcgacttctccagaaacattgcctctctggggggcggcgccctgcaggcctctgagggcaattgcgagctggtggataatgggtacgtgctgttcagggataacagagggagggtgtatggcggagcaatttcttgcctgagaggcgacgtggttatctccggcaacaaagggagggtggagtttaaggataacattgccacaagactgtacgtggaggaaaccgtcgaaaaggttgaggaggtggaacccgcccctgagcagaaggacaataatgagctgagctttctgggcagtgctgagcagtcttttattacagctgccaatcaggccctgttcgcatccgaggatggagatctctccccagagagcagcatcagcagcgaggagctggccaagcggagagagtgcgccggaggcgcaatctttgccaagagagtcagaattgttgacaatcaggaggcagtggtgttcagcaataatttttccgacatctatgggggcgccattttcacaggcagcctgagagaggaagacaaactcgatgggcagattccagaagtgctgatctccggcaacgctggcgatgtcgtgttcagcgggaactccagtaagagggatgaacatctcccacacacaggaggcggagccatctgcacacagaatctgacaatctcccagaacaccggcaacgtgctgttctacaacaacgtggcctgcagcggcggggcagtgagaattgaggatcacgggaatgtgctgctcgaggcctttggcggcgatatcgtctttaaggggaatagcagctttagggctcaggggtccgacgctatctacttcgctggcaaggaatctcatatcaccgcactgaacgccactgagggacacgcaatcgtgtttcacgatgccctggtgtttgagaacctggaggagcgcaaaagcgccgaggtgctgctgatcaactcacgcgagaatcctggctatacaggctccattcggttcctggaagcagaaagcaaagtgcctcagtgcatccacgtgcagcagggatccctggaactgctgaacggggccaccctctgctcttacgggttcaagcaggatgctggggctaagctggtgctggccagcggaagcaagctgaaaattctggattctggaacaccagtgcagggacacgccgtgagcaaacctgaagctgagattgagagctctagcgagcccgagggagctcattctctgtggattgcaaaaaacgcacagactaccgtgccaatggttgacatccacaccatcagcgtggacctggccagctttagtagcagccagcaggagggaacagtggaagccccccaggtcatcgtgcctggcggatcttacgtgaggagcggcgaactgaacctggagctggtgaatactaccgggacagggtacgagaaccacgccctgctgaaaaacgaggccaaggtgcctctgatgtctttcgtggcaagctctgacgaggctagcgcagagattagcaacctgtctgtgtccgacctgcagatccgcgtcgtcactccagagatcgaggaagacacctatggccacatgggcgactggagcgaagccaaaattcaggacggaaccctggtcatcaattggaaccctactggctacagactggacccacagaaggctggcgccctggtgtttaacgctctgtgggaggagggcgccgtcctgtctgcactgaaaaacgctagattcgcacacaacctgactgcccagaggatggaattcgactactctaccaacgtgtggggatttgcctttggcgggttccggacactgagcgcagagaacctggttgccatcgatggatataaaggcgcttacggctctgcatctgcaggcgtggatatccagctgatggaggactttgtgctgggcgtgagcggggcagcttttctgggcaaaatggatagccagaagtttgacgcagaagtcagccggaagggcgtggtcggctccgtgtatactggctttctggccggaagctggttcttcaaggggcagtacagcctgggcgaaacccagaatgatatgaaaacaagatacggcgtcctgggagagtcctccgctagctggacaagcagaggggtgctcgcagatgccctggtggagtatcgctccctggtgggcccagtgaggcccacattttacgccctgcacttcaacccttatgttgaagtgtcctatgcctccatgaaattccccggattcacagagcagggacgggaggcccggtcttttgaggatgcaagcctgaccaacatcaccatcccactgggcatgaagttcgaacttgcctttatcaagggacagttctccgaggttaactccctgggcatctcctatgcttgggaggcatacagaaaagtggagggaggcgccgtgcagctgctggaggcaggctttgattgggagggcgctcctatggatctgcctagacaggagctgcgggtggccctggagaataacactgagtggtcttcctatttttctactgtgctcggcctgactgccttttgcggagggttcacatccaccgccagcaagctgggctatgaggctaacgccggcctgcggctgatcttcggctcctctcaccatcaccaccatcaccatcatggagggtctggaggctctggaggatctgcatggagccacccccagtttgaaaagtaa

SEQ ID NO: 772 - RNA, 2370 nt, synthetic construct
  source 1..2370: mol_type = other RNA
tcatctgagaaagacatcaaatctacatgcagcaagttttccctgagcgtggtcgccgccatcctggcttccgtttccggacttgcctcctgtgtggatctgcacgcaggagggcagagcgttaacgagctggtgtatgtgggaccccaggctgtcctgctgctggaccagatccgcgacctctttgtggggtccaaggacagccaggctgagggacagtacagactcatcgtcggcgacccatcttccttccaggagaaggacgccgatactctgcccgggaaggtggagcagtctacactgttcagcgtgaccaacccagttgtgtttcagggggtggaccagcaggaccaggtgtcttcccagggcctgatctgcagcttcacatcctccaacctcgacagccctcgcgacggcgagtctttcctggggattgccttcgtgggcgacagctccaaagccgggatcaccctgacagacgtcaaggcttccctgtccggcgctgcactgtactctaccgaggacctgatcttcgagaaaattaagggaggcctggagttcgcttcttgttcttctctggaacagggcggcgcatgtgctgcacagtccatcctgattcacgattgtcaaggactccaggtgaaacattgcacaactgccgtgaatgcagagggatcctccgccaatgaccacctgggatttggaggcggcgcattctttgtgacagggtccctctccggcgagaagtctctgtacatgccagctggagacatggtcgtggccaactgtgacggcgcaatcagcttcgagggaaatagcgcaaattttgccaatggaggcgctatcgccgctagcggcaaagtgctgttcgtggctaatgacaagaaaacatccttcatcgagaacagagccctgtctggcggagctattgcagccagtagcgatatcgccttccagaactgcgcagaactggtgttcaaaggcaactgtgctatcggcaccgaggataaaggaagtctgggcgggggggccatctcctctctgggcacagtgctgctgcagggcaatcacggaattacctgtgacaagaatgagagcgcaagccaggggggcgcaatttttggcaagaactgccagatctccgacaatgagggccctgtggtgttcagagatagtaccgcatgtctgggcgggggagccattgccgcccaggagatcgtgagcattcagaacaatcaggccggcattagctttgaggggggaaaggctagcttcggagggggaatcgcttgcgaatccttctcttctgcaggaggggccagcgtcctgggagcaatcgacatctccaagaacctgggcgccattagtttcagcagaaccctgtgcaccacttccgacctgggccagatggaatatcagggcggaggggccctctttggcgaaaatatctctctgagcgagaacgctggggttctgactttcaaggataacattgtgaaaaccttcgcctctaacggaaagattctgggaggcggagccattctggccaccggcaaagtggagattaccaataacagcggcggaatcagctttaccggaaatgcaagagctcctcaggctctgcctacacaggaagaattccccctgtttagcaaaaaggagggaagacccctgagcagcggatacagcggagggggagctattctgggaagagaggtggccatcctgcacaatgccgctgtggtgttcgagcagaaccggctgcagtgtagtgaggaagaggcaaccctgctgggatgttgtggggggggggcagtgcatggcatggatagcacatccatcgtgggcaattcttccgtccggtttggcaataattacgccatggggcagggagtgtctggaggcgcactgttgtctaagacagtgcagctggcaggcaacggctccgtggacttctccagaaacattgcatctctcggaggaggagctctgcaggcatctgagggaaattgcgagctggtggacaacggatacgtgctgtttcgcgataaccgcggcagagtctacgggggcgcaattagctgcctgcggggggatgtggtcatctccggaaacaagggcagagtggagttcaaggataacattgctacccggctgtatgtggaggaaaccgtggagaaagtggaagaggtcgagccagccccagaacagaaagacaataacgagctgtctttcctgggaagcgccgaacagtcctttatcacagccgccaatcaggcaggctcctctcaccatcaccaccatcaccatcatggagggtctggaggctctggaggatctgcatggagccacccccagtttgaaaagtaa

SEQ ID NO: 773 - RNA, 2289 nt, synthetic construct
  source 1..2289: mol_type = other RNA
gacaccatttgtgtggatctgcacgccggcggccagagtgtgaacgagctggtgtacgtcggcccccaggctgtgctgctgctggatcagatcagggacttgttcgttggcagcaaggacagccaggcagagggccagtatagactgattgtgggagatccaagctcctttcaggagaaagacgccgacactctgcccgggaaggtggagcagagcacactgttcagcgtgactaaccccgtggtgtttcagggggtggaccagcaggatcaggtgagctcccagggactgatctgcagtttcacttcttctaacctagacagccctagggacggcgagtctttcctggggattgctttcgtgggcgacagcagcaaggcagggatcactctcaccgacgtgaaggccagcctgtccggtgctgctctgtattccaccgaggacctgatctttgagaagattaagggcggcctggagttcgcttcttgctctagcctcgaacagggaggagcctgtgctgctcagagcatcctgatccacgattgccagggactgcaggtcaagcactgtacaacagccgtcaatgctgaagggtctagcgccaatgaccacctgggctttggcggcggggccttctttgtgaccggctcactgagcggagaaaagtctctgtacatgcctgccggggatatggtggtggccaactgcgatggcgcaatttccttcgaagggaattctgccaacttcgccaacggcggagctatcgctgcaagcggcaaggtgctgttcgtggccaatgataagaagacatcctttatcgagaatcgggcactgtccgggggagccatcgccgccagctccgacatcgcctttcagaattgcgctgagctggtgttcaaggggaattgtgcaatcggcactgaggacaagggcagcctgggcgggggcgccatttcatctctgggaactgtcctgctgcagggaaaccatggcattacatgtgacaagaacgagtccgcatcccagggcggagccatcttcggcaaaaattgccagatttctgacaatgaaggcccagtggtgtttcgggactctaccgcctgcctgggaggaggggccatcgctgctcaggaaatcgtgagcattcagaacaatcaagccggcatctcctttgaaggaggcaaagcctccttcggcggcggaattgcatgtgagtccttctctagcgccggaggagctagcgttctgggagctatcgatatttcaaagaacctgggcgcaatcagcttttccaggactctgtgtaccacttctgacctgggccagatggagtaccagggaggaggagccctgtttggagagaacatctctctgtcagagaacgccggcgtgctgacattcaaggacaacatcgtgaagaccttcgcttccaacggaaagatcctcggcggcggcgctattctggctacaggcaaagtggaaattactaacaacagcggggggatctccttcactggaaacgcccgcgcaccccaagcactgcctacccaggaagagtttcccctgttcagcaaaaaggagggcaggcccctgagttcaggctattccggcggaggcgcaatcctggggagagaggtggccattctgcacaacgccgctgtggtgtttgagcagaacagactgcagtgttccgaggaggaggcaacactgctgggatgctgtggaggaggagcagtgcacggcatggatagcactagcatcgtgggcaactcatccgtgagatttggaaataattacgccatgggccagggagtttcaggcggcgctctgctgtccaagactgtgcagctggctggaaacggcagcgtggatttcagccggaatattgctagcctggggggaggggcactgcaggcctctgaaggaaattgcgagctggtggataatgggtacgtgctgttcagagataaccgggggagggtgtacggcggagctatttcatgtctgcgcggagacgtggtcatctccggaaacaagggcagggtggagttcaaagacaatatcgccacaagactgtatgtggaggaaaccgtggagaaggtcgaggaggtggagcctgcccctgagcagaaggacaataacgaactcagctttctgggcagcgccgagcagtcattcatcactgccgccaaccaggcaggatcttcccatcaccatcatcaccatcaccacggaggatctggcggatccggaggatctgcctggagccacccacagttcgagaagtaa

SEQ ID NO: 774 - RNA, 651 nt, synthetic construct
  source 1..651: mol_type = other RNA
cgcaaaacaatctttaaggccttcaacctgctgtttagcctgctgttcctgtctagctgctcttatccctgccgggattgggagtgtcacggctgcgactctgcacgcccacggaaatcttccttcggctttgtgccattctattctgatgaggagattcagcaggcctttgtggaggattttgattccaaggaggaacagctgtacaagacctctgcacagtctacaagtttccgcaacatcaccttcgccaccgattcttacagcatcaagggggaggacaacctgactattctggcaagcctggtgcgccatctgcataaatcccccaaagctaccctgtacattgagggccacacagatgaacgcggcgcagctgcctacaatctggctctgggagccaggagggcaaatgccgtgaagcagtacctgatcaaacagggcattgctgccgataggctgttcacaatcagctatgggaaagagcatcctgtgcacccagggcacaacgagctggcttggcagcagaataggagaacagagttcaagatccacgctagaggctcctctcaccatcaccaccatcaccatcatggagggtctggaggctctggaggatctgcatggagccacccccagtttgaaaagtaa

SEQ ID NO: 775 - RNA, 603 nt, synthetic construct
  source 1..603: mol_type = other RNA
gataccatctgcagctatccatgtagggactgggagtgccatgggtgcgattctgctcggcctagaaagtcctcctttgggttcgtgcctttctacagcgatgaggagattcagcaggctttcgtggaggattttgacagcaaggaggagcagctgtataagacaagcgcacagtctacttcttttaggaatatcaccttcgccaccgatagctactccatcaagggggaagacaacctgacaattctggcctctctggtgcggcatctgcacaagagccctaaagctactctctatatcgagggacatacagatgagcggggcgccgccgcatacaatctggctctgggagccagaagggcaaacgccgtgaagcagtacctgattaagcagggaatcgccgccgacagactgtttacaatcagctacggcaaagaacacccagtgcatcctgggcataatgagctcgcctggcagcagaacaggagaacagagttcaaaatccacgcccgcggctcctctcaccatcaccaccatcaccatcatggagggtctggaggctctggaggatctgcatggagccacccccagtttgaaaagtaa

SEQ ID NO: 776 - RNA, 1728 nt, synthetic construct
  source 1..1728: mol_type = other RNA
aacaagctcatcaggagggctgtgaccatctttgccgtgactagcgtggcttccctgttcgcctctggggtgctggagacttctatggccgagagcctctccactaacgtcattagcctggcagataccaaagcaaaggacaatacaagccacaagagcaagaaagctaggaagaaccactccaaggagacactggtggatagaaaggaagtggctccagtgcacgagtctaaagccacagggcccaaacaggactcctgcttcggcaggatgtataccgtgaaggtgaacgacgatcgcaatgtggagatcacccaggccgtgcctgagtatgctacagtgggatctccatatccaattgagatcactgccactgggaaacgcgactgcgtggatgtgattattactcagcagctgccttgtgaggccgagttcgtgcggtctgaccctgctaccactcctacagctgatggaaagctggtgtggaagatcgacagactggggcagggagagaaaagcaagatcaccgtgtgggtgaaacctctgaaggaaggatgctgttttaccgccgccactgtttgtgcttgccctgaaatcaggtccgtgactaagtgtggccagcccgctatctgcgtcaagcaggagggccctgaaaatgcatgcctgaggtgcccagtggtttacaagattaatgtggtgaaccagggaaccgccattgccaggaatgttgtggtggagaaccccgtgcctgacgggtatgcccacagctctgggcagagggtgctgaccttcacactcggcgatatgcagccaggcgaacatagaacaatcacagtggagttttgccctctgaagcggggaagggccacaaacatcgccaccgtgtcttattgcgggggccacaagaacacagccagcgttaccacagtgattaacgagccttgtgtccaggtgtccattgctggagcagattggtcctacgtgtgtaagcctgtggagtacgttatttccgtgagcaatcctggcgacctggtgctgagagacgtggttgtggaagatacactgagccctggagtgaccgtgctggaagcagccggagcacagatctcctgcaataaggttgtttggaccgtgaaggagctgaacccaggcgagtcactgcagtataaggtactggtgagagcacagacaccaggccagtttactaacaatgtggtggtgaaatcctgctccgattgcgggacatgtacctcctgtgccgaagcaaccacatactggaaaggggtggccgccactcatatgtgcgtggtggacacatgcgatcctgtgtgcgtcggcgagaacactgtgtaccgaatctgcgtgacaaatcggggaagcgccgaagatacaaacgtctccctgatgctgaagttcagcaaggagctgcagccagtgagctttagcgggcccactaaaggcactattacaggcaataccgtggtgtttgattctctgcctcggctggggtctaaggagactgtggagttctccgtgactctgaaggctgtgtctgctggcgatgcaaggggagaagcaattctgagctccgacaccctgacagtgcccgtgagcgacactgaaaatacacatatctacggctcctctcaccatcaccaccatcaccatcatggagggtctggaggctctggaggatctgcatggagccacccccagtttgaaaagtaa

SEQ ID NO: 777 - RNA, 1647 nt, synthetic construct
  source 1..1647: mol_type = other RNA
gatacaatcgagtcactgagcaccaatgtgattagcctggcagacactaaagccaaggacaacacttcccacaagagcaagaaggctagaaaaaatcacagcaaggagactctggtggacaggaaggaggttgctccagtgcacgagagtaaggccaccgggcccaaacaggactcctgctttggacggatgtacacagtcaaggtgaatgacgatcgcaatgtagaaattacccaggccgtgccagagtatgccaccgtggggtccccatacccaattgagattaccgccactggaaagcgggattgcgtggatgtcattattacacagcagctgccttgtgaggccgagttcgtgaggtctgatcctgcaacaacacctactgctgacgggaagctggtctggaagattgatagactgggccagggagaaaaatctaagatcaccgtgtgggtgaagccactgaaggagggctgctgctttacagcagccactgtgtgtgcttgccctgagattaggtctgtgacaaaatgcggccagcctgccatttgtgtgaagcaggaagggcctgaaaatgcctgcctgcgctgccctgttgtgtacaagattaatgtggtgaatcagggcactgcaattgctcggaacgtcgtggtggagaacccagtgcccgatggatatgctcactccagtgggcagcgggtcctgacattcaccctgggggacatgcagcctggagagcatagaacaatcaccgtggaattttgtcccctgaaaagggggagggcaacaaatattgcaaccgtgtcttactgtggcggacacaagaacacagctagcgttaccactgtgatcaacgagccttgcgtgcaggtgtctatcgctggcgctgactggagctatgtctgcaagcctgtggaatatgtcatctccgtgtccaacccaggggacctggtgctgagagatgtggtcgtggaagacactctgtcccctggcgtgacagtgctggaagcagcaggggcccagattagctgtaacaaggtggtgtggaccgtcaaggagctgaatccaggagagtctctgcagtataaggtgttagtgagagctcagactccaggacagtttaccaacaacgtggtcgtgaaatcctgtagtgattgcggcacatgtacatcttgtgccgaagctaccacatactggaaaggagtggccgctacccacatgtgtgtcgtcgacacctgtgaccctgtgtgtgtcggcgaaaatacagtgtacagaatttgtgtgactaatagaggcagcgccgaagacactaacgttagcctgatgctgaaattcagcaaggagctgcagcccgtgtccttctctgggccaacaaagggcacaattaccggcaatactgtggtgtttgactccctgcctaggctgggcagcaaggagactgttgagtttagtgtgactctgaaagccgtgtccgctggagatgcccggggggaagcaatcctgtccagcgataccctgaccgtcccagttagcgacacagagaatactcatatctacggctcctctcaccatcaccaccatcaccatcatggagggtctggaggctctggaggatctgcatggagccacccccagtttgaaaagtaa

SEQ ID NO: 778 - RNA, 636 nt, synthetic construct
  source 1..636: mol_type = other RNA
acaaccaagcccaagactctggagattgataataacacattcctgctgctggaggggaacctgaagagaatcttcgcaacccccattggctatacaacattcagagagtttcagaacgtggtgttcaactgcgcccaggggcaacaggaactggccaacttcctgttcgagatgctgattaacggaaagctgctgcaggagctgcctgccggacagaaacagtctgcccagtccctgatcgtgcagttcatgatgcccatcagagtggcaaaggacattcacgagcgcggcgagttcattaatttcatcacctccgacatgctggctcagcaggaaagatgcgtgtttctcaatagactgagcagggtggacggccaggagttcctgctgatgaccgacgtgcagaacacatgccacctgatcagacacctcctgtctcggctgctggaggcccagaagaaccccatcggagagaagaatctccaggagatccaggaggatctggattctctgagagcacacttcgaggagctcaccaagtccgtgggatcttcccatcaccatcatcaccatcaccacggaggatctggcggatccggaggatctgcctggagccacccacagttcgagaagtaa

SEQ ID NO: 779 - RNA, 549 nt, synthetic construct
  source 1..549: mol_type = other RNA
accaccaaacccaagacactggagattgataataacactttcctgctgctggagggcaatctgaagagaatctttgccactcccatcggatatacaacctttcgggagttccagaacgtggtgtttaactgcgctcagggccagcaggagctggctaactttctcttcgaaatgctgatcaacggcaagctgctgcaggagctccccgctgggcagaagcagtctgcccagtctctgatcgtgcagtttatgatgccaatcagagtggctaaggacatccatgagaggggcgaattcatcaacttcatcacatccgatatgctggctcagcaggagaggtgcgtgttcctgaacaggctgtctcgggtcgatggccaggagtttctgctgatgaccgacgtgcagaacacatgtcacctgatcaggcacctcctgtccaggctcctggaggcccagaaaaaccccatcggagagaagaacctgcaagagatccaggaggacctggatagcctgagggcacactttgaggagctgactaagtccgtgtaa

SEQ ID NO: 780 - RNA, 639 nt, synthetic construct
  source 1..639: mol_type = other RNA
gacaccactaaacccaagactctggagatcgataataatacattcctgctgcttgagggaaacctgaagagaatctttgccacccccatcggatataccactttccgggagttccagaacgtggtcttcaactgtgcccagggccagcaggagctcgcaaactttctcttcgaaatgctgatcaacggcaagctgctgcaggagctgccagctggacagaaacagtccgcccaatccctgatcgtgcagtttatgatgccaatccgggtggcaaaggacattcacgagagaggagaattcattaactttatcacctccgacatgctggcacagcaggagcgctgcgtgttcctgaatcgcctgtctcgggtggatggccaggaattcctgctgatgactgatgtccagaatacctgccacctcattaggcacctcctgagcagactgctggaagcacagaagaaccccattggagagaagaacctgcaggagatccaggaggacctggatagcctgcgggcacattttgaagaactgacaaagagcgtcggctcctctcaccatcaccaccatcaccatcatggagggtctggaggctctggaggatctgcatggagccacccccagtttgaaaagtaa

SEQ ID NO: 781-789 - skipped (9 entries)

SEQ ID NO: 790 - RNA, 1158 nt, synthetic construct
  source 1..1158: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 791 - RNA, 1158 nt, synthetic construct
  source 1..1158: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggccaggaattcccactggctctgatcgctggcactgatgccgccacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 792 - RNA, 1176 nt, synthetic construct
  source 1..1176: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgacaacgaaaatcagagcacagtgaagacaaattccgtgcctaatatgtctctggatcagagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 793 - RNA, 1131 nt, synthetic construct
  source 1..1131: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 794 - RNA, 1086 nt, synthetic construct
  source 1..1086: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggcgggggaggcggagggaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctgccacagccatctttgacacaaccacactgaacccaaccattgctggagcaggcgacgtgaaggcctccgctgaggggcagctgggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 795 - RNA, 1062 nt, synthetic construct
  source 1..1062: mol_type = other RNA
ctgcctgttggcaatcctgcagagcccagtctgatgatcgatggcatcctgtgggagggattcgggggcgacccatgtgatccatgtaccacatggtgcgatgccatctccatgaggatgggatactacggggacttcgtctttgacagagtgctgaagacagatgtgaacaaggagttccagatgggagataagcccacatccacaacaggaaatgccaccgcccctacaacactgacagcaagggagaaccctgcctatgggaggcacatgcaggatgctgagatgttcaccaacgccgcctgcatggccctgaacatttgggaccggttcgatgtcttttgtactctgggcgcatcctccgggtatctcaagggcaacagcgcctcttttaacctggtgggcctgttcggcgggggaggcggagggagcgtggtggaactgtacactgacaccgccttctcttggagcgtgggagccagagccgctctgtgggaatgtggatgtgcaaccctgggcgctagtttccagtacgcacagtctaaaccaaaagtggaggagctgaacgttctgtgtaatgccgccgagtttactatcaataagccaaagggatatgtgggcgggggaggcggagggacaggcaccaaggacgcctctatcgactatcatgaatggcaggctagcctggcactgagctacagactgaacatgttcacaccctacatcggcgtgaagtggagccgggcatcctttgatgcagacaccattaggattgcacagcccaagtctggcgggggaggcggaggggacactatgcagattgtgagcctgcagctgaacaaaatgaaatccagaaagtcctgtggaattgctgtgggcactaccatcgtggacgccgataagtatgccgttaccgtggagacaaggctgatcgacgaacgcgccgctcacgtgaacgcccagtttagattcggctcctctcaccatcaccaccatcaccatcatggagggtctggaggctctggaggatctgcatggagccacccccagtttgaaaagtaa

SEQ ID NO: 796 - RNA, 1062 nt, synthetic construct
  source 1..1062: mol_type = other RNA
ctgcctgtgggcaacccagctgagccttccctcatgatcgatggcatcctgtgggaggggtttgggggcgatccatgcgatccttgtaccacctggtgcgacgccatcagcatgagaatgggatactacggcgattttgtgttcgatagagtgctgaagaccgacgtgaataaggagtttcagatggggggcggaggaggcgggaacccagcctatggcagacatatgcaggatgccgagatgtttactaacgctgcttgcatggccctgaacatctgggacaggttcgacgtgttctgcactctgggggcatcctccggatatctgaagggcaattcagccagctttaatctcgtgggactcttcggcgacaatgagaaccagagcacagtcaaaaccaactccgtgcccaatatgtccctggatcagagcgtggtggagctgtatacagacacagcctttagctggagcgtgggcgctagagctgctctgtgggagtgtggctgtgcaactctgggcgcttcttttcagtacgcacagtccaagcctaaggtcgaggaactgaacgtgctgtgcaacgctgccgaattcactatcaacaagccaaagggatacgtggggggcggaggaggcgggacaggcacaaaggacgcaagcatcgactaccacgagtggcaggcctccctggctctgtcttataggctgaacatgttcaccccatacatcggcgtgaaatggagcagggctagctttgatgctgatactattcgcatcgctcagcccaaaagcgggggcggaggaggcggggacaccatgcagatcgtgtccctgcagctgaacaaaatgaagtccagaaaatcttgcggcatcgcagtggggacaacaatcgtggacgcagacaagtatgccgtgaccgtggaaactcgcctgatcgacgaacgggcagcccacgtgaacgcccagtttagatttggatcttcccatcaccatcatcaccatcaccacggaggatctggcggatccggaggatctgcctggagccacccacagttcgagaagtaa

SEQ ID NO: 797 - RNA, 1116 nt, synthetic construct; identical to SEQ ID NO: 763
  source 1..1116: mol_type = other RNA

SEQ ID NO: 798-799 - skipped (2 entries)

SEQ ID NO: 800 - RNA, 570 nt, synthetic construct
  source 1..570: mol_type = other RNA
ctggtgccgcgcggcagccatatgacgacgaagccgaagaccctggaaatcgacaataacacgtttctgctgctggaaggtaatctgaagcgcatttttgccaccccgattggctataccacgtttcgtgaattccagaacgtggtttttaattgcgcacagggtcagcaagaactggctaactttctgttcgaaatgctgattaatggcaaactgctgcaggaactgccggcgggtcagaagcaaagcgcccagtctctgatcgtccaattcatgatgccgattcgtgtggcgaaagatatccatgaacgcggcgaatttattaacttcatcaccagtgacatgctggcccagcaagaacgctgcgtttttctgaatcgtctgtcccgcgtcgatggtcaggaattcctgctgatgaccgacgtgcaaaacacgtgtcatctgattcgtcacctgctgagccgcctgctggaagcgcagaaaaacccgatcggcgaaaagaatctgcaggaaatccaagaagacctggacagcctgcgtgcccactttgaagaactgacgaagagcgtg

SEQ ID NO: 801 - RNA, 495 nt, synthetic construct
  source 1..495: mol_type = other RNA
ctggtgccgcgcggcagccatatggatagtgctcgcccgcgtaaatctagctttggttttgtcccgttttattcagacgaagaaattcaacaggcttttgtggaagactttgatagcaaagaagaacagctgtataaaacctctgcccaaagcacgtcttttcgtaacattaccttcgcaacggatagttactccattaaaggcgaagacaatctgaccatcctggcttcactggtccgtcatctgcacaaatcgccgaaagcgaccctgtatatcgaaggtcacacggatgaacgtggtgcagcagcatacaacctggctctgggtgcacgtcgcgcaaatgcagtgaaacagtatctgattaaacaaggtatcgctgcggaccgtctgtttaccatttcctacggcaaagaacatccggttcacccgggtcataacgaactggcctggcagcaaaatcgtcgcacggaattcaaaatccatgcgcgctaatga

SEQ ID NO: 802 - RNA, 1548 nt, synthetic construct
  source 1..1548: mol_type = other RNA
gaaagtctatctacaaatgtaatatcactggctgacaccaaggcgaaagataatacttctcacaaaagcaagaaagctcgcaagaaccatagcaaggaaactttggttgaccgtaaagaagttgcaccggtgcatgaatccaaggcgacgggtccgaaacaggatagctgcttcggccgtatgtataccgtcaaggtgaacgatgatcgcaacgtcgaaatcacccaagcagtgccggaatacgcgaccgtaggttcaccgtatccgattgaaatcacggccaccggcaaacgcgactgtgtggacgtgatcatcacgcagcagctgccgtgtgaagcggagttcgttcgttccgacccggctacaaccccgactgccgacggcaaactggtgtggaaaatcgatcgtctgggccaaggtgagaagtccaagatcaccgtttgggttaagccgctgaaggagggttgttgctttaccgcggcaaccgtgtgcgcgtgcccggagatccgcagtgtgaccaaatgcggtcagccggcgatctgcgtgaaacaagaaggtcccgagaacgcgtgcctgcgttgtccggttgtctacaagatcaacgtagtgaatcagggcaccgcgatcgcgcgtaatgtggtggtcgagaacccggtgccagatggttatgcacattctagcggtcaaagagttttgacctttaccctgggcgacatgcagccgggcgagcaccgtaccatcacggttgaattttgtccgctgaagcgcggtcgtgcaacgaacattgcgactgtatcctactgcggtggtcataaaaacaccgctagcgttaccaccgtgattaatgaaccgtgcgttcaggtttcaattgcgggtgctgactggagctatgtttgtaaaccggtcgagtacgttatcagcgttagcaatccgggagacctggttttacgtgatgttgtggtagaggataccttgtctccgggcgttactgttctggaagccgcgggtgcgcagattagctgcaacaaagttgtttggaccgtgaaagagttgaatccgggtgagagcctgcaatataaagttttggtgcgtgcgcagaccccaggccaatttacgaacaacgtggtggttaaatcttgcagcgactgtggcacctgcactagctgcgcggaagccacgacgtactggaaaggtgtggctgccacccacatgtgtgtcgtcgacacgtgcgacccggtgtgcgttggtgagaacaccgtgtaccgcatttgcgtgaccaaccgtggctctgcagaagataccaatgtttcccttatgctgaagttcagcaaggagctgcagcctgtctcgttcagcggcccaaccaaaggcaccattaccggtaataccgtcgtctttgatagcttaccgcgtctgggttccaaggagacagttgagttcagcgttaccctcaaggccgtttctgcgggggatgcaagaggcgaggcaattctgagcagcgacaccctgaccgtcccggtgtcggacacggaaaacacccatatttac

SEQ ID NO: 803 - protein, 71 aa, Varicella-zoster virus
MSPCGYYSKWRNRDRPEYRRNLRFRRFFSSIHPNAAAGSGFNGPGVFITSVTGVWLCFLCIFSMFVTAVVS

SEQ ID NO: 804 - protein, 30 aa, Varicella-zoster virus
MGTVNKPVVGVLMGFGIITGTLRITNPVRA

SEQ ID NO: 805 - protein, 20 aa, Varicella-zoster virus
MFLIQCLISAVIFYIQVTNA

SEQ ID NO: 806 - protein, 21 aa, Varicella-zoster virus
MQALGIKTEHFIIMCLLSGHA

SEQ ID NO: 807 - protein, 23 aa, Measles
MGLKVNVSAIFMAVLLTLQTPTG

SEQ ID NO: 808 - protein, 21 aa, Rubella
MGAAAALTAVVLQGYNPPAYG

SEQ ID NO: 809 - protein, 23 aa, Rubella
MGAPQAFLAGLLLAAVAVGTARA

SEQ ID NO: 810 - protein, 19 aa, Mumps
MKVFLVTCLGFAVFSSSVC

SEQ ID NO: 811 - protein, 32 aa, Ebola virus
MGVTGILQLPRDRFKRTSFFLWVIILFQRTFS

SEQ ID NO: 812 - protein, 16 aa, Smallpox
MRSLIIFLLFPSIIYS

SEQ ID NO: 813 - protein, 23 aa, Influenza virus
ILAIYSTVASSLVLLVSLGAISF

SEQ ID NO: 814 - protein, 23 aa, Influenza virus
ILAIYSTVASSLVLVVSLGAISF

SEQ ID NO: 815 - protein, 21 aa, Influenza virus
ILWISFAISCFLLCVVLLGFI

SEQ ID NO: 816 - protein, 21 aa, Influenza virus
STAASSLAVTLMLAIFIVYMV

SEQ ID NO: 817 - protein, 21 aa, SARS CoV-2
WYIWLGFIAGLIAIVMVTIML

SEQ ID NO: 818 - protein, 21 aa, Varicella-zoster virus
FGALAVGLLVLAGLVAAFFAY

SEQ ID NO: 819 - protein, 21 aa, Varicella-zoster virus
AAWTGGLAAVVLLCLVIFLIC

SEQ ID NO: 820 - protein, 21 aa, Varicella-zoster virus
IIIPIVASVMILTAMVIVIVI

SEQ ID NO: 821 - protein, 21 aa, Varicella-zoster virus
YFWCVQLKMIFFAWFVYGMYL

SEQ ID NO: 822 - protein, 21 aa, Measles
IVYILIAVCLGGLIGIPALIC

SEQ ID NO: 823 - protein, 21 aa, Rubella
LDHAFAAFVLLVPWVLIFMVC

SEQ ID NO: 824 - protein, 21 aa, Rubella
WWQLTLGAICALLLAGLLACC

SEQ ID NO: 825 - protein, 21 aa, Mumps
IVAALVLSILSIIISLLFCCW

SEQ ID NO: 826 - protein, 21 aa, Ebola virus
WIPAGIGVTGVIIAVIALFCI

SEQ ID NO: 827 - protein, 5 aa, synthetic construct
DGGGS

SEQ ID NO: 828 - protein, 5 aa, synthetic construct
TGEKP

SEQ ID NO: 829 - protein, 4 aa, synthetic construct
GGRR

SEQ ID NO: 830 - protein, 5 aa, synthetic construct
  REPEAT 1..5: note = 1, 2, 3, 4 or 5 repeats
GGGGS

SEQ ID NO: 831 - protein, 14 aa, synthetic construct
EGKSSGSGSESKVD

SEQ ID NO: 832 - protein, 18 aa, synthetic construct
KESGSVSSEQLAQFRSLD

SEQ ID NO: 833 - protein, 8 aa, synthetic construct
GGRRGGGS

SEQ ID NO: 834 - protein, 9 aa, synthetic construct
LRQRDGERP

SEQ ID NO: 835 - protein, 12 aa, synthetic construct
LRQKDGGGSERP

SEQ ID NO: 836 - protein, 18 aa, synthetic construct
GSTSGSGKPGSGEGSTKG

SEQ ID NO: 837 - RNA, 11 nt, synthetic construct
  source 1..11: mol_type = other RNA
gggatcctacc

SEQ ID NO: 838 - RNA, 140 nt, synthetic construct
  source 1..140: mol_type = other RNA
ggacagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 839 - RNA, 100 nt, synthetic construct
  source 1..100: mol_type = other RNA
cgggtggcatccctgtgacccctccccagtgcctctcctggccctggaagttgccactccagtgcccaccagccttgtcctaataaaattaagttgcatc

SEQ ID NO: 840 - RNA, 110 nt, synthetic construct
  source 1..110: mol_type = other RNA
aaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 841 - protein, 274 aa, synthetic construct
NMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLN

SEQ ID NO: 842 - protein, 500 aa, synthetic construct
DAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRSAFDSDTIRIAQPKSATAIFDTTTLNPTIAGAGDVKTGAEGQLGDTMQIVSLQLNNMFTPYIGVKWSRSAFDSDTIRIAQPKSATAIFDTTTLNPTIAGAGDVKASAEGQLGDTMQIVSLQLNNMFTPYIGVKWSRSAFDSDTIRIAQPRLVTPVVDITTLNPTIAGSGSVAGANTEFQISDTMQIVSLQLNNMFTPYIGVKWSRASFDSNTIRIAQPKLAKPVVDITTLNPTIAGSGSVVAANSEGQISDTMQIVSLQLN

SEQ ID NO: 843 - protein, 500 aa, synthetic construct
DAISMRVGYYGDFVFDRVLKTDVNKEFQMGAKPTTDTGNSAAPSTLTARENPAYGRHMQDAEMFTNAASMALNIWDRFDVFSTLGATSGYLKGNSASFNLVGLFGDNENQKTVKAESVPNMSFDQSVVELYTDTTFAWSVGARAALWESGSATLGASFQYAQSKPKVEELNVLSNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNNMFTPYIGVKWSRASFDADTIRIAQPKSATAIFDTTTLNPTIAGAGDVKASAEGQLGDTMQIVSLQLNNMFTPYIGVKWSRASFDSDTIRIAQPRLVTPVVDITTLNPTIAGSGSVAGANTEGQISDTMQIVSLQLNNMFTPYIGVKWSRASFDSNTIRIAQPKLAKPVVDITTLNPTIAGSGSVVAANSEGQISDTMQIVSLQLN

SEQ ID NO: 844 - protein, 168 aa, synthetic construct
CSYPCRDWECHGCDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 845 - protein, 19 aa, Rabies
MVPQALLFVPLLVFPLCFG

SEQ ID NO: 846 - protein, 17 aa, Influenza virus
MKAILVVLLYTFTTANA

SEQ ID NO: 847 - protein, 17 aa, Influenza virus
MKVKLLVLLCTFTATYA

SEQ ID NO: 848 - protein, 17 aa, Influenza virus
MKAILVVMLYTFTTANA

SEQ ID NO: 849 - protein, 16 aa, Influenza virus
MKTIIALSYILCLVFT

SEQ ID NO: 850 - protein, 16 aa, Influenza virus
MKTIIALSNILCLVFA

SEQ ID NO: 851 - protein, 16 aa, Influenza virus
MKAIIALSNILCLVFA

SEQ ID NO: 852 - protein, 16 aa, Influenza virus
MKTIIALSCILCLVFA

SEQ ID NO: 853 - protein, 16 aa, Influenza virus
MKTIIALSHILCLVFA

SEQ ID NO: 854 - protein, 15 aa, Influenza virus
MKAIIVLLMVVTSSA

SEQ ID NO: 855 - protein, 15 aa, Influenza virus
MEAIIVLLMVVTSNA

SEQ ID NO: 856 - protein, 17 aa, Influenza virus
  VARIANT 8: note = L or M
  VARIANT 14: note = T or A
  VARIANT 3: note = A or V
  VARIANT 4: note = I or K
  VARIANT 10: note = Y or C
  VARIANT 13: note = T or A
  VARIANT 15: note = T or A
  VARIANT 16: note = N or Y
  VARIANT 6: note = V or L
MKXXLXVXLXTFXXXXA

SEQ ID NO: 857 - protein, 16 aa, Influenza virus
  VARIANT 3: note = T or A
  VARIANT 9: note = Y, N, C or H
  VARIANT 16: note = T or A
MKXIIALSXILCLVFX

SEQ ID NO: 858 - protein, 15 aa, Influenza virus
  VARIANT 14: note = S or N
MKAIIVLLMVVTSXA

SEQ ID NO: 859 - protein, 15 aa, Influenza virus
  VARIANT 2: note = K or E
MXAIIVLLMVVTSNA

SEQ ID NO: 860 - protein, 21 aa, Rabies
VLLSAGALTALMLIIFLMTCW

SEQ ID NO: 861 - RNA, 1182 nt, synthetic construct; identical to SEQ ID NO: 425
  source 1..1182: mol_type = other RNA

SEQ ID NO: 862 - RNA, 879 nt, synthetic construct
  source 1..879: mol_type = other RNA
atgaaggccaagctgctggtgctgctgtgcacctttactgccacatacgccaacatgttcactccatatattggcgtcaaatggtcccggagcgcattcgacagcgatactatcagaatcgcccagccaaaatccgctacagcaatctttgatacaacaaccctgaatccaaccatcgccggcgcaggcgacgtgaagacaggggccgagggccagctgggagatacaatgcagatcgtctccctgcagctgaacaacatgtttacaccttacatcggagtgaagtggagccgctctgccttcgacagcgacacaatcaggatcgcccaacccaagagcgctacagctatttttgacaccactaccctgaacccaactatcgctggagctggcgacgtgaaagcatccgccgagggccagctcggcgataccatgcagatcgtgtctctccagctgaataacatgttcacaccctacatcggcgttaagtggagcagatccgcattcgattccgatactatcaggatcgcccagcccaggctcgtgacccctgtcgtggatatcacaaccctgaaccctaccattgccgggagcggaagcgtggctggcgccaacacagagtttcagattagcgatacaatgcagatcgtgtccctgcagctcaacaacatgttcactccttatatcggcgttaagtggtcacgcgcatctttcgacagcaatactattcggatcgcccagcctaagctggccaaacctgtggtggacatcacaaccctgaatcccactattgctggcagcggcagcgtggtggcagcaaactctgagggacagatttctgatacaatgcagattgtctcactgcagctgaactgatga

SEQ ID NO: 863 - RNA, 1233 nt, synthetic construct
  source 1..1233: mol_type = other RNA
atgaaagccaaactgctggtgctgctgtgcaccttcacagccacctacgccatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccactagcaccctgtccaagctggtggagcggaccaaccctgcctatggaaagcacatgcaggacgcctcttccggatacctgaagggcaactccgctagcttcaatttggttggcctgttcggggacaacgagaatcagtccaccgtgaagactaactccgtgcctaacatgtccctggaccagtccgttgtggagctgtacacagataccgctacaagcggctatctgaaaggcaactctgctagcttcaacctggttggcctgttcggagacggcgtgaacgccacaaaacccgccgccgatagcattccaaatgtgcagctgaaccagtccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccaacaatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccacaatcgccggctgcggatccgtcgtggccgctaatacagagggccaaatttccgacaccatgcagattgtgtcactgcagctgaactgatga

SEQ ID NO: 864 - RNA, 1149 nt, synthetic construct
  source 1..1149: mol_type = other RNA
atgaaagccaaactgctggtgctgctgtgcaccttcacagccacctacgccatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactaccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaatctacagtgaagactaacagcgtgccaaacatgtccctggaccagtccgtggtggagctctacactgataccgccacttccggctatctgaagggaaatagcgcctctttcaacctggtcggcctgttcggagacggcgtcaacgcaaccaagcctgccgccgactccatcccaaacgtgcagctgaatcagagcgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccaaccatcgccggagctggggatgtgaaggctagcgcagaggggcagctgggagacacaatgcagaggatcgctcagccaaagctggccaagccagtggttgatatcaccactctgaatccaacaattgccggctgcggctccgtggtggctgccaatactgaggggcagatctcagacaccatgcagtgatga

SEQ ID NO: 865 - RNA, 1320 nt, synthetic construct
  source 1..1320: mol_type = other RNA
atgaaagccaaactgctggtgctgctgtgcaccttcacagccacctacgccatttccatgagagtggggtactacggagatttcgtgttcgatagggtgctgaagacagatgtgaacaaagagtttcagatgggagcaaagcccaccactgacacaggaaatagcgccgccccaagcactctgactgcccgcgagaaccccgcttatggaagacacatgcaggacatcagcatgagaatgggctactatggcgacttcgtttttgaccgggtgctgaagaccgacgtcaacaaggaatttgagatgggggaggctctggcaggagcttctggaaataccgccagcaccctgtccaagctggtggagcggaccaaccctgcctatggaaagcacatgcaggacgcctcttccggatacctgaagggcaactccgctagcttcaatttggttggcctgttcggggacaacgagaatcaggccaccgtgaagactaactccgtgcctaacatggccctggaccagtccgttgtggagctgtacacagataccgctacaagcggctatctgaaaggcaactctgctagcttcaacctggttggcctgttcggagacggcgtggccgccacaaaacccgccgccgatagcattccaaatgtgcagctgaaccaggccgtggtggagctctataccgatacagagttcaccatcaataagccgaaagggtatgtcggccaagagttcccactggccctgacagccggaacagatgccgccaccggaaccaaggacgcaagcattgattaccacgagtggcagaacatgtttaccccttacatcggggtgaaatggtcacgggctagctttgatgccgacaccattaggattgcccagccaaagagcgccacagccatcttcgataccacaaccctgaatccagccatcgccggagcaggggatgtaaaggctagcgccgagggccagctgggagacactatgcagatcgtgtccctgcagctcaataacatgtttactccttacattggggtgaagtggtccagggcctccttcgactccaacaccatcaggatcgcacagcctaagctggccaaaccagtcgtggatattacaactctgaaccccgccatcgccggctgcggatccgtcgtggccgctaatacagagggccaaatttccgacaccatgcagattgtgtcactgcagctgaacagcggctctattctggccatctacagtactgtggcttcctccctggtgctgctggtgtctctgggcgccatttccttcggctctggctgatga

SEQ ID NO: 866 - RNA, 1236 nt, synthetic construct
  source 1..1236: mol_type = other RNA
atgaaagccaaactgctggtgctgctgtgcaccttcacagccacctacgccatttccatgcgcgtgggctattatggcgactttgtgttcgaccgcgtgctgaagaccgacgtgaataaggagtttcagatgggcgccaagccaacaacagacaccggcaactctgctgcacctagcacactgacagctagagagaaccctgcatacggaaggcacatgcaggatgccgagatgtttacaaacgccgcttgcatggccctgaacatcatctccatgagaatggggtactacggcgacttcgtgtttgatagagtgctgaagaccgacgtcaacaaggagtttgaaatgggcgaggctctggctggcgcaagcggcaacactgccagcactctgagcaagctggtggagaggacaaatccagcctatggcaaacatatgcaggacgccgagatgttcactaacgcagcctgcatgaccctgaatatcgctagctccggatatctgaagggcaattccgccagcttcaacctggtgggcctgttcggagacaatgagaatcaagccacagtgaagactaacagcgtgccaaacatggccctggaccagtccgtggtggagctctacactgataccgccacttccggctatctgaagggaaatagcgcctctttcaacctggtcggcctgttcggagacggcgtcgccgcaaccaagcctgccgccgactccatcccaaacgtgcagctgaatcaggccgtggtggagctgtacacagacaccgaattcactatcaacaagcctaaagggtacgtggggcaggaatttcccctcgcactgaccgctggaaccgatgctgccactggaaccaaggatgccagcattgactaccacgagtggcagagaattgcacagcctaagagcgctaccgccatcttcgacactacaacactgaacccagccatcgccggagctggggatgtgaaggctagcgcagaggggcagctgggagacacaatgcagaggatcgctcagccaaagctggccaagccagtggttgatatcaccactctgaatccagccattgccggctgcggctccgtggtggctgccaatactgaggggcagatctcagacaccatgcagagcggctctattctggccatctacagtactgtggcttcctccctggtgctgctggtgtctctgggcgccatttccttcggctctggctgatga

SEQ ID NO: 867 - RNA, 1320 nt, synthetic construct
  source 1..1320: mol_type = other RNA
atgaaggctatcctggtggtgctgctgtatacttttgccaccgccaatgccatttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactccggctccatcctggccatctatagcaccgtggctagcagcctggtgctggtggtgtccctgggagctattagcttcggatctggctgatga

SEQ ID NO: 868 - RNA, 1233 nt, synthetic construct
  source 1..1233: mol_type = other RNA
atgaaggccaagctgctggtgctgctgtgcacctttactgccacatacgccatttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactgatga

SEQ ID NO: 869 - RNA, 1233 nt, synthetic construct
  source 1..1233: mol_type = other RNA
atgaaggctatcctggtggtgctgctgtatacttttgccaccgccaatgccatttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactgatga

SEQ ID NO: 870 - RNA, 1149 nt, synthetic construct
  source 1..1149: mol_type = other RNA
atgaaggccaagctgctggtgctgctgtgcacctttactgccacatacgccatttccatgcggatgggctattacggcgacttcgtgtttgacagagtgctgaaaaccgatgtgaataaggagtttcaaatgggagataagccaactagcactaccggagccgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacagcctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatggccttcgatcagtccgtcgtggagctgtataccgacacagccacatctggctacctgagaggaaatagcgcctcattcaacttagttgggctgtttggggacagcgaggccgctactcagcctgcagccacctccatccccaacgtgcagctgaaccaggccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctgccatcgccggagctggcgatgtgaagacaggcgccgaagggcagctgggggatacaatgcagagaatcgcacagccacgcttggtgacaccagtcgtggatattaccaccctgaaccctgccattgcaggatgcgggtccgtggccggcgccaacactgaaggccagattagcgacactatgcagtgatga

SEQ ID NO: 871 - RNA, 1320 nt, synthetic construct
  source 1..1320: mol_type = other RNA
atgaaggccaagctgctggtgctgctgtgcacctttactgccacatacgccatttccatgcgcatgggatactacggggacttcgtgttcgatcgcgtgctgaagacagatgtgaacaaggagtttcagatgggggacaaaccaacctctacaaccggagccgccactgccccaactactctgaccgcacgggagaaccctgcctacgggagacacatgcaggacattagcatgaggatgggctattacggagattttgtgtttgacagggtgctgaaaaccgatgtgaacaaggaatttgaaatgggcgaagctctggctggagctagcggcaataccgccagcaccctgtctaagctggtggagaggactaaccctgcttacggcaagcacatgcaggacgcaacatctggctatctcaaggggaatagcgcctctttcaacctggtgggactgtttggcgacaatgagaatcagaagaccgtgaaggcagagtccgtgccaaacatggccttcgatcagagcgtggtggagctctataccgatacagcaaccagtggatacctgaggggcaactccgcctctttcaacctcgtggggctgttcggagattccgaggccgccacccagcctgctgcaacctccattcctaacgtgcagctgaaccaggccgtggtcgaactgtataccgacacagagttcacaattaacaagccaaagggctatgtgggcaaagagttccctctggacctgaccgcaggaaccgatgctgcaaccggaaccaaggacgcatccatcgactaccacgagtggcagaacatgttcaccccatatattggagtgaagtggtccagagcctcctttgatgccgacactattcgtatcgcccagcctaagtccgcaacagcaatcttcgacacaacaacactgaaccccgccattgctggcgccggcgatgtgaaaaccggcgcagagggccagctcggcgatacaatgcagatcgtgtccctgcagctcaataacatgtttacaccctacatcggggtgaagtggagtcgcgccagcttcgacagcgacaccattaggatcgcacagcccaggctggtgacaccagtggtggacatcaccaccctgaaccccgccattgcaggatgcggctctgtggcaggcgcaaacactgagggccagatcagcgacacaatgcagatcgttagcctgcagttaaactccggctccatcctggccatctatagcaccgtggctagcagcctggtgctgctggtgtccctgggagctattagcttcggatctggctgatga

SEQ ID NO: 872 - RNA, 1236 nt, synthetic construct
  source 1..1236: mol_type = other RNA
atgaaggccaagctgctggtgctgctgtgcacctttactgccacatacgccatttccatgcggatgggctattacggcgacttcgtgtttgacagagtgctgaaaaccgatgtgaataaggagtttcaaatgggagataagccaactagcactaccggaaacgcaactgcccccaccaccctgaccgccagagagaatcccgcatacggacggcacatgcaggacgccgaaatgtttacaaatgccgcatgtatggctctgaatatcatctccatgcgcatggggtactacggagatttcgtgttcgacagggtgctgaagaccgatgtgaataaggaatttgagatgggggaggctctggctggagcttccggcaatacaacctccactctgtctaagctggtggagaggacaaatcccgcctatgggaagcacatgcaggacgcagagatgttcactaatgctgcctgtatgactctgaacattgccacttccgggtacctgaaagggaacagcgcctcctttaacctggtggggctgtttggcgacaacgagaaccaaaaaacagtgaaggctgagtccgttcctaacatgagcttcgatcagtccgtcgtggagctgtataccgacacagccacatctggctacctgagaggaaatagcgcctcattcaacttagttgggctgtttggggacagcgagaacgctactcagcctgcagccacctccatccccaacgtgcagctgaaccagtccgtggtggagctgtacacagacacagagttcaccattaataagcccaaggggtatgtgggcaaggaattccctctggacctcactgccggcacagacgctgctactggcaccaaggacgccagcattgactatcacgagtggcagcggattgcccagccaaaaagcgccaccgcaattttcgatacaacaacactcaaccctaccatcgccggagctggcgatgtgaagacaggcgccgaagggcagctgggggatacaatgcagagaatcgcacagccacgcttggtgacaccagtcgtggatattaccaccctgaaccctacaattgcaggatgcgggtccgtggccggcgccaacactgaaggccagattagcgacactatgcagtccggctccatcctggccatctatagcaccgtggctagcagcctggtgctgctggtgtccctgggagctattagcttcggatctggctgatga

SEQ ID NO: 873 - RNA, 1170 nt, synthetic construct
  source 1..1170: mol_type = other RNA
atgaaggccaagctgctggtgctgctgtgcacctttactgccacatacgccctgcctgtgggcaacccagctgagccaagcctgatgatcgatgggatcctgtgggaaggcttcggaggggatccaagcgaccccagcgccacatggagcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgctagcatggccctgaacatctgggatagattcgacgtgtttagcactctcggcgctacctctggctatctgaagggaaacagcgcctccttcaacctggtggggctgttcggggacaacgagaaccagaaaaccgtcaaggccgagagcgtgcctaatatggccttcgaccagagcgtggtcgagctgtacaccgacaccaccttcgcttggtctgtgggagctagggccgcactgtgggagagcggcagcgcaactctgggcgcctcctttcagtatgcccagtctaagcctaaagtggaggagctgaatgtgctaagcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccagccatcgctggagcaggagacgtgaagactggagccgagggccagctgggagataccatgcagatcgtgagcctgcagctgaacaagatgaaaagccggaaaagcagcggcattgccgtggggacaacaatcgtcgatgctgacaagtacgccgtgactgtggaaaccaggctgattgacgagagggcagcccatgtcaacgcccagttcagattttgatga

SEQ ID NO: 874 - RNA, 1176 nt, synthetic construct
  source 1..1176: mol_type = other RNA
atgaaagccaaactgctggtgctgctgtgcaccttcacagccacctacgccctgccagtgggaaaccctgccgaaccttccctcatgatcgacggaatcctgtgggagggcttcgggggagatcctagcgaccccagcaccacttggagcgatgctatctccatgaggatgggatattatggggacttcgtgttcgaccgggtgctgaagacagacgtcaacaaagagttcgaaatgggggaggccctggcaggagctagcggcaacactacaagcactctgtctaagctggtggagaggaccaacccagcctatggcaagcatatgcaggacgccgagatgtttaccaatgctgcaagcatggccctgaatatctgggaccgatttgatgtcttcagcaccctgggcgccacttcaggatatctgagaggaaattctgcaagttttaacctggtgggactgtttggagattctgagaatgccacccagccagccgctacaagcatccctaacgtgcagctgaaccagagcgttgtggagctgtacacagacactgctttcgcttggtctgtgggagccagagccgctctgtgggagagcgggagcgctactctgggagccagtttccaatacgcacagtctaagcccaaagtggaagaactgaacgtgctgagcaacgctgcacagtttacaattaacaagcctaagggctatgtgggccaggagtttcccctggcactgacagccggaactgatgccgccacaggcactaaggacgcctccattgattaccatgaatggcaggcttctctgtccctgagctacagattgaacatgtttaccccatatatcggagtgaaatggagcagggcctcattcgactctaacacaattcggattgcccagcccaagctggccaagcctgtggtggacatcactacactgaaccctactatcgctggcagcggctcagtggtcgctgcaaacaccgaaggacagatttccgatactatgcagattgtctccctccagctgaataagatgaagtccagaaagagcagcggcattgcagttggcactacaatcgtggacgccgataaatacgccgtgacagtggagacaaggctgattgatgaacgggctgcccacgtgaatgcccagttccgcttctgatga

SEQ ID NO: 875 - RNA, 1170 nt, synthetic construct
  source 1..1170: mol_type = other RNA
atgaaagccaaactgctggtgctgctgtgcaccttcacagccacctacgccctgcctgtggggaatccagctgagcctagtctgatgatcgatggcatcctgtgggaaggctttgggggggacccttgcgacccatgtacaacatggtgcgacgccatctctatgcgcatgggctattacggagacttcgtgtttgacagagtgctgaagaccgatgtcaacaaggaatttcagatgggagacaaacctacctctactaccggcaatgcaaccgcccccactaccctgacagccagagaaaaccctgcctacggccggcacatgcaggacgccgagatgttcaccaacgcagcatgtatggccctgaacatttgggataggtttgacgtgttctgcacactcggcgcttctagcggctatctgaaagggaactccgccagcttcaacctcgtggggctgttcggggacaatgagaatcagagcacagtgaagaccaatagcgtgcccaatatgagcctggaccagtcagtggtggagctgtacacagataccgctttcagctggtccgtgggcgctagagcagcactgtgggagtgtggctgtgccacacttggggcttctttccaatatgcccagtccaagccaaaggtggaagaactgaacgtgctgtgtaacgccgctgaattcaccattaacaagcccaagggatatgtggggcaggagttccctctcgccctcatcgctggcaccgatgccgccaccggaactaaagatgctagcattgactaccatgagtggcaggccagcctggcactgagctaccggctgaacatgttcactccctacattggcgtcaaatggagcagggcctcttttgatgccgacaccatcaggattgcacagcccaagagcgccaccgccatcttcgatacaaccacactgaaccctaccatcgctggtgcaggggatgtgaaagcctccgctgagggccagctgggggataccatgcagattgtctctctgcagctgaacaagatgaaaagcagaaaaagttgcggcatcgccgtggggacaactattgtggatgcagataagtatgcagtgaccgtggagacaagactgattgacgagagagccgcccacgtgaacgcccaattccgcttctgatga

SEQ ID NO: 876 - RNA, 1170 nt, synthetic construct
  source 1..1170: mol_type = other RNA
atgaaggccaagctgctggtgctgctgtgcacctttactgccacatacgccctgccagtggggaaccctgcagaaccctctctgatgatcgatggaattctgtgggagggcttcggcggggatcctagcgaccccagcaccacatggagcgacgctattagcatgagaatggggtactacggcgacttcgtgttcgaccgggtgctgaagactgacgtgaataaggaattccagatgggcgataaacctacctccacaacaggggccgccactgctcccacaacactgaccgcccgcgaaaatccagcctatgggcgccacatgcaggacgccgagatgtttaccaacgccgccagcatggctctgaacatctgggaccggttcgacgtgtttagcacactgggggcatcctccggctatctgaaaggcaactctgcctcttttaacctggtgggcctgtttggcgataacgagaatcaggccactgttaagactaactctgtgcccaatatggccctggaccagtccgtggtcgaactctatactgatacagccttctcctggagcgtgggagctagagccgcactgtgggaaagcggcagcgcaacactgggggcttcctttcagtacgcccagagcaagcctaaagtggaagaactgaatgtgctgagcaatgccgccgagtttaccatcaacaagcccaaggggtacgtgggccaggaattccccctggctctgattgcagggacagacgctgccaccggcacaaaggatgcatccattgattaccatgaatggcaggcatccctggctctgagctatagactgaacatgttcaccccctacattggcgtgaagtggtcccgggccagcttcgatgcagacaccatccggattgctcagcctaagagcgctaccgccatcttcgacactacaactctgaatcctgccatcgcaggagccggggatgtcaaggcttctgccgagggccagctgggagataccatgcagatcgtgtccctgcagctgaacaaaatgaagtctcgcaagtccagcgggatcgctgtgggaacaactattgtggacgccgacaaatacgcagtgacagttgaaaccagactgatcgacgagcgcgccgcacacgtgaatgctcagtttaggttttgatga

SEQ ID NO: 877 - RNA, 1233 nt, synthetic construct
  source 1..1233: mol_type = other RNA
atgaaggccaagctgctggtgctgctgtgcacctttactgccacatacgccatttccatgagagtgggctattatggagactttgtgtttgatagggtgctgaagacagatgtgaacaaggaattccagatgggcgccaagcccacaaccgacaccggcaattctgctgccccttctaccctgacagcccgggaaaatcctgcttacggaaggcatatgcaggacatttctatgcggatgggatactacggcgacttcgtgtttgatcgggtgctgaagacagacgtgaacaaggaatttgaaatgggcgaagccctcgctggagcatctggcaacacagcctctacactgtccaagctggtggagcgcaccaaccctgcctacgggaagcacatgcaggatgcatccagcgggtacctgaagggcaatagcgcctcttttaacctcgtgggcctgtttggagataacgagaaccaggccactgtcaagacaaatagcgtgcctaacatggccctggaccagagcgtcgtggaactgtacactgacactgccacctctggctacctgaagggaaactccgcttctttcaatcttgtgggactgtttggagacggagtggccgccaccaagccagcagccgatagcatccccaacgtgcagctgaaccaggccgtcgtggagctgtacacagatacagagttcacaattaacaagcctaaggggtacgtggggcaggagtttcccctcgccctgaccgctggaactgatgctgcaaccgggaccaaggacgcctctatcgactaccacgagtggcagaacatgtttaccccttatattggcgttaagtggtccagggctagctttgatgccgataccatccgcatcgcccagccaaagagcgccaccgccatctttgacaccactaccctcaaccctgccatcgccggcgcaggcgacgtcaaagctagcgctgaaggacagctgggcgatactatgcagatcgtgtccctgcagctcaataacatgttcaccccctacattggcgtcaagtggtcccgcgcctccttcgatagtaacacaatcagaatcgcccagcccaaactggccaaacccgtggtggacattacaacattgaatccagccatcgcaggatgcggcagcgtggtggccgctaatactgaaggccagatctccgataccatgcagattgtgtctctgcagctgaactgatga

SEQ ID NO: 878 - RNA, 1149 nt, synthetic construct
  source 1..1149: mol_type = other RNA
atgaaggccaagctgctggtgctgctgtgcacctttactgccacatacgccatcagcatgagggtgggctattatggcgactttgtgttcgacagagtgctgaagaccgacgtgaataaggagttccagatgggagccaagcccaccaccgacactgggaacagcgctgctccctccactctgactgctagagaaaacccagcctatgggaggcacatgcaggacgccgagatgtttaccaacgctgcctgcatggccctgaatatcatcagcatgagaatgggctactatggagattttgtcttcgaccgcgtgctgaagaccgatgtgaacaaggagtttgagatgggcgaggccctggctggcgctagcggcaatacagcctccactctgagcaagctggtggaaagaaccaaccctgcctacggcaagcatatgcaggatgccgagatgtttacaaatgccgcctgcatgacactgaacatcgcttcctccggatacctgaagggaaatagcgccagctttaacctcgtgggcctgttcggcgacaacgagaaccaggccactgtcaaaaccaacagcgtgcccaacatggccctcgaccagtccgtggtggaactgtacacagacactgctacatccggctacctgaaggggaatagcgccagcttcaacctggtgggactgttcggagacggcgtggccgccaccaaacctgctgctgatagcattccaaacgttcagctgaaccaggccgtggtggagctgtatactgacacagagttcaccattaacaaaccaaagggctatgtgggacaggagttccccctggcactgaccgctggaacagacgcagctaccggaaccaaggacgcttctatcgactaccacgagtggcagaggatcgcacagcctaagtccgccaccgccattttcgacacaacaaccctgaatcccgccattgccggggccggcgacgtgaaggcttccgccgaaggacagctgggggataccatgcagaggatcgcccagcccaagctggccaaacccgtggtggacattacaaccctgaatcccgccattgcaggctgcggctctgtggtggctgccaacactgagggacagatttccgatactatgcagtgatga

SEQ ID NO: 879 - RNA, 1170 nt, synthetic construct
  source 1..1170: mol_type = other RNA
atgaaggccaagctgctggtgctgctgtgcacctttactgccacatacgccctgcctgtgggcaacccagctgagccaagcctgatgatcgatgggatcctgtgggaaggcttcggaggggatccatgcgacccctgtgccacatggtgcgacgctatttctatgagagtggggtattacggcgacttcgtgtttgatcgcgtgctgaagaccgacgtgaacaaagagttccagatgggagcaaaacccacaaccgataccgggaactccgctgccccttccactctgaccgccagagagaatcctgcctatggcagacacatgcaggatgccgagatgtttacaaacgctgcttgcatggccctgaacatctgggatagattcgacgtgttttgcactctcggcgctacctctggctatctgaagggaaacagcgcctccttcaacctggtggggctgttcggggacaacgagaaccagaaaaccgtcaaggccgagagcgtgcctaatatgtctttcgaccagagcgtggtcgagctgtacaccgacaccaccttcgcttggtctgtgggagctagggccgcactgtgggagtgtggctgtgcaactctgggcgcctcctttcagtatgcccagtctaagcctaaagtggaggagctgaatgtgctatgcaacgctgcagagttcacaattaacaaacctaaggggtatgtgggcaaagagttcccactggacctgactgccggaaccgacgctgctaccggaaccaaggacgccagcatcgactatcacgagtggcaggcctctctggctctgtcttacaggctgaacatgttcacaccttacattggcgtgaagtggagtcgggcctcttttgatgccgataccatccgcatcgcccagccaaaatccgctaccgccatcttcgatactaccaccctgaacccaacaatcgctggagcaggagacgtgaagactggagccgagggccagctgggagataccatgcagatcgtgagcctgcagctgaacaagatgaaaagccggaaaagctgcggcattgccgtggggacaacaatcgtcgatgctgacaagtacgccgtgactgtggaaaccaggctgattgacgagagggcagcccatgtcaacgcccagttcagattttgatga

SEQ ID NO: 880 - RNA, 1176 nt, synthetic construct
  source 1..1176: mol_type = other RNA
atgaaggccaagctgctggtgctgctgtgcacctttactgccacatacgccctgccagtgggaaatccagccgaacctagcctgatgattgatggcatcctgtgggagggctttggaggcgatccatgcgatccttgtactacttggtgcgacgccatttccatgcgcatgggctactatggcgatttcgtgttcgaccgcgtgctgaaaaccgacgtgaacaaggagttcgaaatgggcgaagccctggctggcgcaagcggaaacactacttccaccctgtccaagctggtggagaggacaaaccccgcctatggaaagcatatgcaggacgccgaaatgttcacaaatgccgcatgcatgacactgaatatctgggacagatttgacgtcttctgcacactgggcgccacaagcggatacctgaagggcaactctgccagttttaacctggtcggactgttcggcgacggcgtgaatgccaccaaaccagccgcagactctattccaaacgttcagctgaaccagtccgtcgtggagctgtacaccgacaccacattcgcttggtccgtcggagcaagagctgccctgtgggagtgcgggtgtgctacactcggcgcatccttccagtatgcccagtctaagcccaaaattgaggagctcaacgtgctgtgcaatgccgccgagtttaccatcaacaagcccaagggatacgtgggaaaagagtttcctctggacctgacagccggcactgatgctgctactggcaccaaagacgcttctatcgactaccacgagtggcaggcttccctgtctctgtcctaccggctgaacatgttcaccccttatattggagtgaagtggtcccgcgcctcttttgatagcgacaccattaggatcgcccagccaagactggtgactcccgttgtggacatcaccactctgaatccaactatcgctggatgcggctctgtggccggagcaaacacagaggggcagatcagcgacactatgcagatcgtgtctctgcagctgaacaaaatgaagtctcgcaagtcctgcggcatcgcagtgggcacaactatcgtggatgctgataagtatgccgtgactgttgaaacccggctgatcgacgagcgcgcagcccacgtgaatgctcagtttaggttttgatga

SEQ ID NO: 881 - RNA, 1176 nt, synthetic construct
  source 1..1176: mol_type = other RNA
atgaaggccaagctgctggtgctgctgtgcacctttactgccacatacgccctcccagttggcaatcctgccgagccatccctgatgattgatggaatcctgtgggagggcttcggcggagatccatgcgatccctgcacaacctggtgtgacgccatttccatgcggatgggctattacggggactttgtgttcgacagagtgctgaagacagacgtgaataaggagttcgaaatgggagaggcactggctggagcctctggaaacacaaccagcacactgagcaagctggtggagcggacaaaccctgcttacggcaagcacatgcaggatgcagagatgttcactaatgccgcatgtatggctctgaatatctgggatcgcttcgacgtgttttgcactctgggcgccacttccggctatctgagaggcaatagtgcttccttcaacctggtcgggctgttcggcgattccgagaacgctactcagcccgctgcaaccagcattcccaatgtgcaactgaatcagagcgtggtggaactgtatactgatactgcattcgcctggtctgtcggagctagagccgctctgtgggagtgtggatgtgccactctgggagcttcctttcagtatgcacagagcaaacctaaagtggaggaactgaatgtgctgtgtaatgccgctcagttcaccatcaacaaaccaaaaggctacgtgggacaggagtttcccctggctctgacagcaggcacagacgccgcaacagggactaaggacgcctctattgattatcacgaatggcaagccagcctgagcctgagctacagactgaacatgttcaccccatatatcggagtgaagtggagcagggcctccttcgacagcaacacaattaggattgcacagccaaagctggctaagccagtggtggacattaccaccctgaaccccacaatcgctggatgcgggagcgttgtggcagctaacactgaggggcagatctctgacactatgcagatcgtttccttgcagctgaacaaaatgaagtcccgcaaatcttgcggcattgctgtgggcaccaccattgtggacgccgacaagtatgccgtgacagtggagacaaggctgattgacgaaagggccgcccacgtgaacgcacagtttaggttttgatga

SEQ ID NO: 882 - protein, 30 aa, synthetic construct
SATAIFDTTTLNPTIAGAGDVKTGAEGQLG

SEQ ID NO: 883 - protein, 30 aa, synthetic construct
SATAIFDTTTLNPTIAGAGDVKASAEGQLG

SEQ ID NO: 884 - protein, 31 aa, synthetic construct
LVTPVVDITTLNPTIAGCGSVAGANTEGQIS

SEQ ID NO: 885 - protein, 31 aa, synthetic construct
LAKPVVDITTLNPTIAGCGSVVAANTEGQIS

The invention claimed is:

1. A composition comprising:
   (i) a nucleic acid comprising a nucleotide sequence encoding a modified Major Outer Membrane Protein (MOMP) polypeptide, wherein the modified MOMP polypeptide has an amino acid sequence comprising two or more conserved domain sequences of a native *Chlamydia trachomatis* MOMP polypeptide and a non-native loop sequence between the conserved domain sequences;
   (ii) a nucleic acid that comprises a nucleotide sequence encoding a chimeric *Chlamydia trachomatis* MOMP variable domain (VD) polypeptide, wherein the chimeric MOMP VD polypeptide comprises an amino acid sequence comprising two or more *Chlamydia trachomatis* MOMP VD sequences of different serovars of *Chlamydia trachomatis*;
   (iii) a nucleic acid that comprises a nucleotide sequence encoding a *Chlamydia trachomatis* CT443 polypeptide; and
   (iv) a nucleic acid that comprises a nucleotide sequence encoding a *Chlamydia trachomatis* CT584 polypeptide.

2. A nucleic acid comprising a nucleotide sequence encoding a modified Major Outer Membrane Protein (MOMP) polypeptide, wherein the modified MOMP polypeptide has an amino acid sequence comprising two or more conserved domain sequences of a native *Chlamydia* sp. MOMP polypeptide and a non-native loop sequence between the conserved domain sequences.

3. The nucleic acid of claim 2, wherein:
   (i) the modified MOMP polypeptide does not comprise a native *Chlamydia* sp. MOMP variable domain between the two or more conserved domain sequences;
   (ii) the modified MOMP polypeptide comprises three, four or five conserved domain sequences of a native *Chlamydia* sp. MOMP polypeptide;
   (iii) the modified MOMP polypeptide comprises three, four or five conserved domain sequences of a native *Chlamydia* sp. MOMP polypeptide and a non-native loop sequence between each of the conserved domain sequences; and/or
   (iv) the non-native loop sequence is between 3 and 30 amino acids in length.

4. The nucleic acid of claim 2, wherein:
   (i) a non-native loop sequence comprising a sequence according to SEQ ID NO: 462 or 466 replaces variable domain 1 between the conserved domain sequences;
   (ii) a non-native loop sequence comprising a sequence according to SEQ ID NO: 463 or 467 replaces variable domain 2 between the conserved domain sequences;
   (iii) a non-native loop sequence comprising a sequence according to SEQ ID NO: 464 or 468 replaces variable domain 3 between the conserved domain sequences; and/or
   (iv) a non-native loop sequence comprising a sequence according to SEQ ID NO: 465 or 469 replaces variable domain 4 between the conserved domain sequences.

5. The nucleic acid of claim 2, wherein:
   (i) the modified MOMP polypeptide comprises a sequence according to any one of SEQ ID NOs: 486-489 or a sequence that has at least 70% identity thereto;
   (ii) the modified MOMP polypeptide further comprises a secretion signal peptide sequence; and/or
   (iii) the nucleic acid comprises a nucleotide sequence according to any one of SEQ ID NOs: 551-566 or a sequence that has at least 50% identity thereto.

6. A modified Major Outer Membrane Protein (MOMP) polypeptide having an amino acid sequence comprising two or more conserved domain sequences of a native *Chlamydia* sp. MOMP polypeptide and a non-native loop sequence between the conserved domain sequences.

7. The modified MOMP polypeptide of claim 6, wherein:
   (i) the modified MOMP polypeptide does not comprise a native *Chlamydia* sp. MOMP variable domain between the two or more conserved domain sequences;
   (ii) the modified MOMP polypeptide comprises three, four or five conserved domain sequences of a native *Chlamydia* sp. MOMP polypeptide;
   (iii) the modified MOMP polypeptide comprises three, four or five conserved domain sequences of a native *Chlamydia* sp. MOMP polypeptide and a non-native loop sequence between each of the conserved domain sequences; and/or
   (iv) the non-native loop sequence is between 3 and 30 amino acids in length.

8. The modified MOMP polypeptide of claim 6, wherein:
   (i) a non-native loop sequence comprising a sequence according to SEQ ID NO: 462 or 466 replaces variable domain 1 between the conserved domain sequences;
   (ii) a non-native loop sequence comprising a sequence according to SEQ ID NO: 463 or 467 replaces variable domain 2 between the conserved domain sequences;
   (iii) a non-native loop sequence comprising a sequence according to SEQ ID NO: 464 or 468 replaces variable domain 3 between the conserved domain sequences; and/or
   (iv) a non-native loop sequence replacing VD4 comprises a sequence according to SEQ ID NO: 465 or 469 replaces variable domain 4 between the conserved domain sequences.

9. The modified MOMP polypeptide of claim 6, wherein the modified MOMP polypeptide comprises a sequence according to any one of SEQ ID NOs: 486-489 or a sequence that has at least 70% identity thereto.

10. A composition comprising the nucleic acid of claim 2.

11. A composition comprising the modified MOMP polypeptide of claim 6.

12. A method of treating or preventing at least one symptom of a *Chlamydia* sp. infection in a subject, the method comprising administering the composition of claim 1 to the subject, wherein the infection is a *C. trachomatis* infection, and wherein the nucleic acid of (i), the nucleic acid of (ii), the nucleic acid of (iii) and the nucleic acid of (iv) are each expressed in the subject.

13. A method of treating or preventing at least one symptom of a *Chlamydia* sp. infection in a subject, the method comprising administering the modified MOMP polypeptide of claim 6 to the subject, wherein the infection is a *C. trachomatis* infection.

14. The composition of claim 1, wherein one or more nucleic acids is a mRNA.

15. The composition of claim 14, wherein:
(i) the mRNA comprises at least one 5' untranslated region (5' UTR), at least one 3' untranslated region (3' UTR), and/or at least one polyadenylation (poly(A)) sequence; and/or
(ii) the mRNA is chemically modified and wherein the chemical modification consists of $N_1$-methylpseudouridine in place of every uridine.

16. The composition of claim 1, wherein the composition further comprises a lipid nanoparticle (LNP).

17. The composition of claim 16, wherein:
(i) the LNP comprises at least one cationic lipid, wherein the cationic lipid is selected from the group consisting of OF-02, cKK-E10, OF-Deg-Lin, GL-HEPES-E3-E10-DS-3-E18-1, GL-HEPES-E3-E12-DS-4-E10, GL-HEPES-E3-E12-DS-3-E14, SM-102, ALC-0315, ATX-126, and IM-001; and/or
(ii) the LNP comprises a polyethylene glycol (PEG) conjugated (PEGylated) lipid, a cholesterol-based lipid, and a helper lipid.

18. The composition of claim 1, wherein:
(i) the nucleic acid that comprises a nucleotide sequence encoding a *Chlamydia trachomatis* modified Major Outer Membrane Protein (MOMP) polypeptide is a mRNA which comprises the following structural elements:
a 5' cap;
a 5' untranslated region (5' UTR);
a nucleotide sequence encoding the modified Major Outer Membrane Protein (MOMP) polypeptide comprising the sequence according to SEQ ID NO: 486;
a 3' untranslated region (3' UTR); and
a polyA tail;
(ii) the nucleic acid comprising a nucleotide sequence encoding the chimeric *Chlamydia trachomatis* MOMP VD polypeptide is a mRNA which comprises the following structural elements:
a 5' cap;
a 5' untranslated region (5' UTR);
a nucleotide sequence encoding the chimeric *Chlamydia trachomatis* MOMP VD polypeptide comprising the sequence according to SEQ ID NO: 503;
a 3' untranslated region (3' UTR); and
a polyA tail;
(iii) the nucleic acid that comprises a nucleotide sequence encoding a *Chlamydia trachomatis* CT443 polypeptide is a mRNA which comprises the following structural elements:
a 5' cap;
a 5' untranslated region (5' UTR);
a nucleotide sequence encoding the *Chlamydia trachomatis* CT443 polypeptide comprising the sequence according to SEQ ID NO 507;
a 3' untranslated region (3' UTR); and
a polyA tail; and
(iv) the nucleic acid that comprises a nucleotide sequence encoding a *Chlamydia trachomatis* CT584 polypeptide is a mRNA which comprises the following structural elements:
a 5' cap;
a 5' untranslated region (5' UTR);
a nucleotide sequence encoding the *Chlamydia trachomatis* CT584 polypeptide comprising the sequence according to SEQ ID NO: 510;
a 3' untranslated region (3' UTR); and
a polyA tail;
wherein the mRNA is chemically modified and wherein the chemical modification consists of $N_1$-methylpseudouridine in place of every uridine.

19. The composition of claim 1, wherein the composition is immunogenic.

20. The nucleic acid of claim 2, wherein the *Chlamydia* sp. is *Chlamydia* trachomatis.

21. The nucleic acid of claim 3, wherein:
(i) the modified MOMP polypeptide comprises all five full-length conserved domains of a native *Chlamydia* sp. MOMP polypeptide;
(ii) the conserved domains of the modified MOMP polypeptide collectively have at least 95% sequence identity to the conserved domains of a native MOMP polypeptide;
(iii) the modified MOMP polypeptide comprises four non-native loop sequences and does not comprise any native *Chlamydia* sp. MOMP variable domains between the conserved domain sequences; and/or
(iv) the non-native loop sequence is between 4 and 20 amino acids in length.

22. The nucleic acid of claim 2, wherein the nucleic acid is a mRNA.

23. The nucleic acid of claim 22, wherein:
(i) the mRNA comprises at least one 5' untranslated region (5' UTR), at least one 3' untranslated region (3' UTR), and/or at least one polyadenylation (poly(A)) sequence; and/or
(ii) the mRNA is chemically modified and wherein the chemical modification consists of $N_1$-methylpseudouridine in place of every uridine.

24. The modified MOMP polypeptide of claim 6, wherein the *Chlamydia* sp. is *Chlamydia trachomatis*.

25. The modified MOMP polypeptide of claim 7, wherein:
(i) the modified MOMP polypeptide comprises all five full-length conserved domains of a native *Chlamydia* sp. MOMP polypeptide;
(ii) the conserved domains of the modified MOMP polypeptide collectively have at least 95% sequence identity to the conserved domains of a native MOMP polypeptide;
(iii) the modified MOMP polypeptide comprises four non-native loop sequences and does not comprise any native *Chlamydia* sp. MOMP variable domains between the conserved domain sequences; and/or
(iv) the non-native loop sequence is between 4 and 20 amino acids in length.

26. The composition of claim 10, wherein the composition further comprises a lipid nanoparticle (LNP).

27. The composition of claim 26, wherein:
(i) the LNP comprises at least one cationic lipid, wherein the cationic lipid is selected from the group consisting of OF-02, cKK-E10, OF-Deg-Lin, GL-HEPES-E3-E10-DS-3-E18-1, GL-HEPES-E3-E12-DS-4-E10, GL-HEPES-E3-E12-DS-3-E14, SM-102, ALC-0315, ATX-126, and IM-001; and/or (ii) the LNP comprises a polyethylene glycol (PEG) conjugated (PEGylated) lipid, a cholesterol-based lipid, and a helper lipid.

28. The composition of claim 10, wherein the composition further comprises:
(i) a nucleic acid that comprises a nucleotide sequence encoding a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
(ii) one or more of:
   (a) a nucleic acid that comprises a nucleotide sequence encoding a *Chlamydia* sp. CT443 polypeptide;
   (b) a nucleic acid that comprises a nucleotide sequence encoding a *Chlamydia* sp. CT584 polypeptide;
   (c) a nucleic acid that comprises a nucleotide sequence encoding a *Chlamydia* sp. CT600 polypeptide; and
   (d) a nucleic acid that comprises a nucleotide sequence encoding a *Chlamydia* sp. CT812 polypeptide.

29. The composition of claim 11, wherein the composition further comprises:
(i) a chimeric *Chlamydia* sp. MOMP variable domain (VD) polypeptide, wherein the chimeric MOMP VD polypeptide comprises an amino acid sequence comprising two or more *Chlamydia* sp. MOMP VD sequences of different serovars of the *Chlamydia* sp.; and/or
(ii) one or more of:
   (a) a polypeptide comprising amino acid sequence of a *Chlamydia* sp. CT443 polypeptide;
   (b) a polypeptide comprising amino acid sequence of a *Chlamydia* sp. CT584 polypeptide;
   (c) a polypeptide comprising amino acid sequence of a *Chlamydia* sp. CT600 polypeptide; or
   (d) a polypeptide comprising amino acid sequence of a *Chlamydia* sp. CT812 polypeptide.

30. A method of treating or preventing at least one symptom of a *Chlamydia* sp. infection in a subject, the method comprising administering the composition of claim 10 to the subject, wherein the infection is a *C. trachomatis* infection, and wherein the nucleic acid is expressed in the subject.

31. The method of claim 12, wherein the composition further comprises a lipid nanoparticle (LNP).

32. The method of claim 31, wherein the nucleic acid is encapsulated in the LNP.

33. The method of claim 30, wherein the composition further comprises a lipid nanoparticle (LNP).

34. The method of claim 33, wherein the nucleic acid is encapsulated in the LNP.

35. A method of generating an immune response against a *Chlamydia* sp. infection in a subject, the method comprising administering the composition of claim 1 to the subject, wherein the infection is a *C. trachomatis* infection, and wherein the nucleic acid of (i), the nucleic acid of (ii), the nucleic acid of (iii), and the nucleic acid of (iv) are each expressed in the subject.

36. A method of generating an immune response against a *Chlamydia* sp. infection in a subject, the method comprising administering the modified MOMP polypeptide of claim 6 to the subject, wherein the infection is a *C. trachomatis* infection.

37. A method of generating an immune response against a *Chlamydia* sp. infection in a subject, the method comprising administering the composition of claim 10 to the subject, wherein the infection is a *C. trachomatis* infection, and wherein the nucleic acid is expressed in the subject.

38. The composition of claim 1, wherein:
(i) the modified MOMP polypeptide comprises the sequence according to SEQ ID NO: 486;
(ii) the chimeric *Chlamydia trachomatis* MOMP VD polypeptide comprises the sequence according to SEQ ID NO: 503;
(iii) the *Chlamydia trachomatis* CT443 polypeptide comprises the sequence according to SEQ ID NO 507; and
(iv) the *Chlamydia trachomatis* CT584 polypeptide comprises the sequence according to SEQ ID NO: 510.

* * * * *